United States Patent 11,851,653 (MATERIALS AND METHODS FOR TREATMENT OF ALPHA-1 ANTITRYPSIN DEFICIENCY) - sequence listing, part 3

SEQ ID NO: 65572 - DNA, 22 bp, Artificial Sequence
  chemically synthesized
ctattgaccaaaatgcgacaag

SEQ ID NO: 65573 - DNA, 22 bp, Artificial Sequence
  chemically synthesized
ttgaccaaaatgcgacaagttg

SEQ ID NO: 65574 - DNA, 22 bp, Artificial Sequence
  chemically synthesized
accaaaatgcgacaagttgacc

SEQ ID NO: 65575 - DNA, 22 bp, Artificial Sequence
  chemically synthesized
accatctaaaatcaaatcataa

SEQ ID NO: 65576 - DNA, 22 bp, Artificial Sequence
  chemically synthesized
aaatcaaatcataattatagtt

SEQ ID NO: 65577 - DNA, 22 bp, Artificial Sequence
  chemically synthesized
tagttcaataggacacattgag

SEQ ID NO: 65578 - DNA, 22 bp, Artificial Sequence
  chemically synthesized
aataggacacattgagtctctt

SEQ ID NO: 65579 - DNA, 22 bp, Artificial Sequence
  chemically synthesized
agtctcttaaaagcttccaatc

SEQ ID NO: 65580 - DNA, 22 bp, Artificial Sequence
  chemically synthesized
ttaaaagcttccaatccgtaat

SEQ ID NO: 65581 - DNA, 22 bp, Artificial Sequence
  chemically synthesized
aaaagcttccaatccgtaatga

SEQ ID NO: 65582 - DNA, 22 bp, Artificial Sequence
  chemically synthesized
aaagcttccaatccgtaatgac

SEQ ID NO: 65583 - DNA, 22 bp, Artificial Sequence
  chemically synthesized
ccaatccgtaatgaccatcaag

SEQ ID NO: 65584 - DNA, 22 bp, Artificial Sequence
  chemically synthesized
caatccgtaatgaccatcaagg

SEQ ID NO: 65585 - DNA, 22 bp, Artificial Sequence
  chemically synthesized
aaaagagtaaagttaaaataaa

SEQ ID NO: 65586 - DNA, 22 bp, Artificial Sequence
  chemically synthesized
aaataaagttcagaaaaggtta

SEQ ID NO: 65587 - DNA, 22 bp, Artificial Sequence
  chemically synthesized
agaaaaggttagctgcaataaa

SEQ ID NO: 65588 - DNA, 22 bp, Artificial Sequence
  chemically synthesized
gctgcaataaaacatgagtttt

SEQ ID NO: 65589 - DNA, 22 bp, Artificial Sequence
  chemically synthesized
caataaaacatgagttttagta

SEQ ID NO: 65590 - DNA, 22 bp, Artificial Sequence
  chemically synthesized
tagtaattttaacaagaagggg

SEQ ID NO: 65591 - DNA, 22 bp, Artificial Sequence
  chemically synthesized
agtaattttaacaagaagggga

SEQ ID NO: 65592 - DNA, 22 bp, Artificial Sequence
  chemically synthesized
gtaattttaacaagaaggggat

SEQ ID NO: 65593 - DNA, 22 bp, Artificial Sequence
  chemically synthesized
taacaagaaggggatgaagcta

SEQ ID NO: 65594 - DNA, 22 bp, Artificial Sequence
  chemically synthesized
aacaagaaggggatgaagctat

SEQ ID NO: 65595 - DNA, 22 bp, Artificial Sequence
  chemically synthesized
acaagaaggggatgaagctata

SEQ ID NO: 65596 - DNA, 22 bp, Artificial Sequence
  chemically synthesized
tagatgcatttttattccttct

SEQ ID NO: 65597 - DNA, 22 bp, Artificial Sequence
  chemically synthesized
ttattccttcttttaactatgt

SEQ ID NO: 65598 - DNA, 22 bp, Artificial Sequence
  chemically synthesized
tattccttcttttaactatgtt

SEQ ID NO: 65599 - DNA, 22 bp, Artificial Sequence
  chemically synthesized
attccttcttttaactatgttg

SEQ ID NO: 65600 - DNA, 22 bp, Artificial Sequence
  chemically synthesized
ttccttcttttaactatgttgc

SEQ ID NO: 65601 - DNA, 22 bp, Artificial Sequence
  chemically synthesized
cttcttttaactatgttgcccc

SEQ ID NO: 65602 - DNA, 22 bp, Artificial Sequence
  chemically synthesized
cttttaactatgttgcccctta

SEQ ID NO: 65603 - DNA, 22 bp, Artificial Sequence
  chemically synthesized
ttttaactatgttgccccttat

SEQ ID NO: 65604 - DNA, 22 bp, Artificial Sequence
  chemically synthesized
ttaactatgttgccccttataa

SEQ ID NO: 65605 - DNA, 22 bp, Artificial Sequence
  chemically synthesized
taactatgttgccccttataat

SEQ ID NO: 65606 - DNA, 22 bp, Artificial Sequence
  chemically synthesized
aactatgttgccccttataatg

SEQ ID NO: 65607 - DNA, 22 bp, Artificial Sequence
  chemically synthesized
actatgttgccccttataatgt

SEQ ID NO: 65608 - DNA, 22 bp, Artificial Sequence
  chemically synthesized
tgttgccccttataatgtatag

SEQ ID NO: 65609 - DNA, 22 bp, Artificial Sequence
  chemically synthesized
ccccttataatgtatagctttg

SEQ ID NO: 65610 - DNA, 22 bp, Artificial Sequence
  chemically synthesized
ataatgtatagctttgccttat

SEQ ID NO: 65611 - DNA, 22 bp, Artificial Sequence
  chemically synthesized
taatgtatagctttgccttatt

SEQ ID NO: 65612 - DNA, 22 bp, Artificial Sequence
  chemically synthesized
tgccttatttttctctgtctga

SEQ ID NO: 65613 - DNA, 22 bp, Artificial Sequence
  chemically synthesized
gccttatttttctctgtctgag

SEQ ID NO: 65614 - DNA, 22 bp, Artificial Sequence
  chemically synthesized
ccttatttttctctgtctgagt

SEQ ID NO: 65615 - DNA, 22 bp, Artificial Sequence
  chemically synthesized
atttttctctgtctgagtaagg

SEQ ID NO: 65616 - DNA, 22 bp, Artificial Sequence
  chemically synthesized
tttttctctgtctgagtaagga

SEQ ID NO: 65617 - DNA, 22 bp, Artificial Sequence
  chemically synthesized
ttctctgtctgagtaaggataa

SEQ ID NO: 65618 - DNA, 22 bp, Artificial Sequence
  chemically synthesized
tctctgtctgagtaaggataaa

SEQ ID NO: 65619 - DNA, 22 bp, Artificial Sequence
  chemically synthesized
ctctgtctgagtaaggataaag

SEQ ID NO: 65620 - DNA, 22 bp, Artificial Sequence
  chemically synthesized
tctgtctgagtaaggataaaga

SEQ ID NO: 65621 - DNA, 22 bp, Artificial Sequence
  chemically synthesized
tgtctgagtaaggataaagagt

SEQ ID NO: 65622 - DNA, 22 bp, Artificial Sequence
  chemically synthesized
tctgagtaaggataaagagtaa

SEQ ID NO: 65623 - DNA, 22 bp, Artificial Sequence
  chemically synthesized
agtaaggataaagagtaaaggc

SEQ ID NO: 65624 - DNA, 22 bp, Artificial Sequence
  chemically synthesized
acacctgtaattccagcacttt

SEQ ID NO: 65625 - DNA, 22 bp, Artificial Sequence
  chemically synthesized
taattccagcactttgggaggc

SEQ ID NO: 65626 - DNA, 22 bp, Artificial Sequence
  chemically synthesized
cagcactttgggaggccgaggc

SEQ ID NO: 65627 - DNA, 22 bp, Artificial Sequence
  chemically synthesized
tgggaggccgaggcgggcagat

SEQ ID NO: 65628 - DNA, 22 bp, Artificial Sequence
  chemically synthesized
gggaggccgaggcgggcagata

SEQ ID NO: 65629 - DNA, 22 bp, Artificial Sequence
  chemically synthesized
ggaggccgaggcgggcagataa

SEQ ID NO: 65630 - DNA, 22 bp, Artificial Sequence
  chemically synthesized
gaggccaggagtttgagaccag

SEQ ID NO: 65631 - DNA, 22 bp, Artificial Sequence
  chemically synthesized
aggccaggagtttgagaccagc

SEQ ID NO: 65632 - DNA, 22 bp, Artificial Sequence
  chemically synthesized
gagaccagcctggccaacatgg

SEQ ID NO: 65633 - DNA, 22 bp, Artificial Sequence
  chemically synthesized
agaccagcctggccaacatggt

SEQ ID NO: 65634 - DNA, 22 bp, Artificial Sequence
  chemically synthesized
gccaacatggtgaaaccctgtc

SEQ ID NO: 65635 - DNA, 22 bp, Artificial Sequence
  chemically synthesized
tcactactaaaaatacaaaaat

SEQ ID NO: 65636 - DNA, 22 bp, Artificial Sequence
  chemically synthesized
ctaaaaatacaaaaattaactg

SEQ ID NO: 65637 - DNA, 22 bp, Artificial Sequence
  chemically synthesized
aaaatacaaaaattaactggaa

SEQ ID NO: 65638 - DNA, 22 bp, Artificial Sequence
  chemically synthesized
actggaattggtagcacatgcc

SEQ ID NO: 65639 - DNA, 22 bp, Artificial Sequence
  chemically synthesized
gaattggtagcacatgcctgta

SEQ ID NO: 65640 - DNA, 22 bp, Artificial Sequence
  chemically synthesized
gtagcacatgcctgtaatgcca

SEQ ID NO: 65641 - DNA, 22 bp, Artificial Sequence
  chemically synthesized
taatgccagctactctggaggc

SEQ ID NO: 65642 - DNA, 22 bp, Artificial Sequence
  chemically synthesized
ctctggaggctgaggcacgaga

SEQ ID NO: 65643 - DNA, 22 bp, Artificial Sequence
  chemically synthesized
tggaggctgaggcacgagaatc

SEQ ID NO: 65644 - DNA, 22 bp, Artificial Sequence
  chemically synthesized
gaggctgaggcacgagaatcgc

SEQ ID NO: 65645 - DNA, 22 bp, Artificial Sequence
  chemically synthesized
aggcacgagaatcgctcgtaat

SEQ ID NO: 65646 - DNA, 22 bp, Artificial Sequence
  chemically synthesized
gtaattccagaattcgagaggt

SEQ ID NO: 65647 - DNA, 22 bp, Artificial Sequence
  chemically synthesized
cagaattcgagaggtggagttt

SEQ ID NO: 65648 - DNA, 22 bp, Artificial Sequence
  chemically synthesized
gagaggtggagtttgcagtaag

SEQ ID NO: 65649 - DNA, 22 bp, Artificial Sequence
  chemically synthesized
gcagtaagccaagattgcgcca

SEQ ID NO: 65650 - DNA, 22 bp, Artificial Sequence
  chemically synthesized
cagtaagccaagattgcgccac

SEQ ID NO: 65651 - DNA, 22 bp, Artificial Sequence
  chemically synthesized
cgccactgtactccagcctggg

SEQ ID NO: 65652 - DNA, 22 bp, Artificial Sequence
  chemically synthesized
tactccagcctgggtgactgag

SEQ ID NO: 65653 - DNA, 22 bp, Artificial Sequence
  chemically synthesized
cagcctgggtgactgagtgaga

SEQ ID NO: 65654 - DNA, 22 bp, Artificial Sequence
  chemically synthesized
ggtgactgagtgagactctgtc

SEQ ID NO: 65655 - DNA, 22 bp, Artificial Sequence
  chemically synthesized
agtgagactctgtctcaaaaaa

SEQ ID NO: 65656 - DNA, 22 bp, Artificial Sequence
  chemically synthesized
tgtctcaaaaaaaaaaaaaaaa

SEQ ID NO: 65657 - DNA, 22 bp, Artificial Sequence
  chemically synthesized
tctcaaaaaaaaaaaaaaaaag

SEQ ID NO: 65658 - DNA, 22 bp, Artificial Sequence
  chemically synthesized
aaaaaaaaaaaaaaaaagaaga

SEQ ID NO: 65659 - DNA, 22 bp, Artificial Sequence
  chemically synthesized
tgagtaggccacatagttccag

SEQ ID NO: 65660 - DNA, 22 bp, Artificial Sequence
  chemically synthesized
cagaaaatgcagaaatcccccc

SEQ ID NO: 65661 - DNA, 22 bp, Artificial Sequence
  chemically synthesized
ccctccccaacacacaggaagt

SEQ ID NO: 65662 - DNA, 22 bp, Artificial Sequence
  chemically synthesized
cccaacacacaggaagtggctc

SEQ ID NO: 65663 - DNA, 22 bp, Artificial Sequence
  chemically synthesized
aggagattacacacagaaggaa

SEQ ID NO: 65664 - DNA, 22 bp, Artificial Sequence
  chemically synthesized
cacacagaaggaaagtgtgtct

SEQ ID NO: 65665 - DNA, 22 bp, Artificial Sequence
  chemically synthesized
ctggggttttgcaagttggcta

SEQ ID NO: 65666 - DNA, 22 bp, Artificial Sequence
  chemically synthesized
gggttttgcaagttggctaatt

SEQ ID NO: 65667 - DNA, 22 bp, Artificial Sequence
  chemically synthesized
tgcaagttggctaatttgaaag

SEQ ID NO: 65668 - DNA, 22 bp, Artificial Sequence
  chemically synthesized
gcaagttggctaatttgaaagg

SEQ ID NO: 65669 - DNA, 22 bp, Artificial Sequence
  chemically synthesized
caagttggctaatttgaaaggt

SEQ ID NO: 65670 - DNA, 22 bp, Artificial Sequence
  chemically synthesized
gctaatttgaaaggtgactgga

SEQ ID NO: 65671 - DNA, 22 bp, Artificial Sequence
  chemically synthesized
atttgaaaggtgactggaggag

SEQ ID NO: 65672 - DNA, 22 bp, Artificial Sequence
  chemically synthesized
gaaaggtgactggaggaggtga

SEQ ID NO: 65673 - DNA, 22 bp, Artificial Sequence
  chemically synthesized
aaaggtgactggaggaggtgaa

SEQ ID NO: 65674 - DNA, 22 bp, Artificial Sequence
  chemically synthesized
gaggaggtgaaaaaatggtgca

SEQ ID NO: 65675 - DNA, 22 bp, Artificial Sequence
  chemically synthesized
cattcattcattaaatgagtta

SEQ ID NO: 65676 - DNA, 22 bp, Artificial Sequence
  chemically synthesized
attcattcattaaatgagttat

SEQ ID NO: 65677 - DNA, 22 bp, Artificial Sequence
  chemically synthesized
attcattaaatgagttataaga

SEQ ID NO: 65678 - DNA, 22 bp, Artificial Sequence
  chemically synthesized
attaaatgagttataagaagac

SEQ ID NO: 65679 - DNA, 22 bp, Artificial Sequence
  chemically synthesized
aatgagttataagaagacagac

SEQ ID NO: 65680 - DNA, 22 bp, Artificial Sequence
  chemically synthesized
taagaagacagacacaagtgtc

SEQ ID NO: 65681 - DNA, 22 bp, Artificial Sequence
  chemically synthesized
tgctaacagagctctgtgttaa

SEQ ID NO: 65682 - DNA, 22 bp, Artificial Sequence
  chemically synthesized
acagagctctgtgttaaacacc

SEQ ID NO: 65683 - DNA, 22 bp, Artificial Sequence
  chemically synthesized
tgtgttaaacaccccaccagca

SEQ ID NO: 65684 - DNA, 22 bp, Artificial Sequence
  chemically synthesized
tgttaaacaccccaccagcatc

SEQ ID NO: 65685 - DNA, 22 bp, Artificial Sequence
  chemically synthesized
aacaccccaccagcatcgcctc

SEQ ID NO: 65686 - DNA, 22 bp, Artificial Sequence
  chemically synthesized
atctaagcctcagaagagctat

SEQ ID NO: 65687 - DNA, 22 bp, Artificial Sequence
  chemically synthesized
agcctcagaagagctatgtggg

SEQ ID NO: 65688 - DNA, 22 bp, Artificial Sequence
  chemically synthesized
agaagagctatgtgggaaagaa

SEQ ID NO: 65689 - DNA, 22 bp, Artificial Sequence
  chemically synthesized
tgtgggaaagaaacttttatcc

SEQ ID NO: 65690 - DNA, 22 bp, Artificial Sequence
  chemically synthesized
ttatccctattttatagatgag

SEQ ID NO: 65691 - DNA, 22 bp, Artificial Sequence
  chemically synthesized
tatccctattttatagatgagg

SEQ ID NO: 65692 - DNA, 22 bp, Artificial Sequence
  chemically synthesized
atccctattttatagatgagga

SEQ ID NO: 65693 - DNA, 22 bp, Artificial Sequence
  chemically synthesized
tccctattttatagatgaggaa

SEQ ID NO: 65694 - DNA, 22 bp, Artificial Sequence
  chemically synthesized
ttttatagatgaggaaaccaag

SEQ ID NO: 65695 - DNA, 22 bp, Artificial Sequence
  chemically synthesized
tatagatgaggaaaccaaggct

SEQ ID NO: 65696 - DNA, 22 bp, Artificial Sequence
  chemically synthesized
atagatgaggaaaccaaggctc

SEQ ID NO: 65697 - DNA, 22 bp, Artificial Sequence
  chemically synthesized
tagatgaggaaaccaaggctca

SEQ ID NO: 65698 - DNA, 22 bp, Artificial Sequence
  chemically synthesized
agagaactgagggcctcccccg

SEQ ID NO: 65699 - DNA, 22 bp, Artificial Sequence
  chemically synthesized
agggcctcccccggatccaagt

SEQ ID NO: 65700 - DNA, 22 bp, Artificial Sequence
  chemically synthesized
ccccggatccaagtccacctag

SEQ ID NO: 65701 - DNA, 22 bp, Artificial Sequence
  chemically synthesized
gctgcagtcaccccacatcctc

SEQ ID NO: 65702 - DNA, 22 bp, Artificial Sequence
  chemically synthesized
cagtcaccccacatcctctgca

SEQ ID NO: 65703 - DNA, 22 bp, Artificial Sequence
  chemically synthesized
tgcatgtcacaggtgctcagaa

SEQ ID NO: 65704 - DNA, 22 bp, Artificial Sequence
  chemically synthesized
catgtcacaggtgctcagaaag

SEQ ID NO: 65705 - DNA, 22 bp, Artificial Sequence
  chemically synthesized
agaaagatgctgaaggcacctg

SEQ ID NO: 65706 - DNA, 22 bp, Artificial Sequence
  chemically synthesized
aaggcacctggcccttcacctt

SEQ ID NO: 65707 - DNA, 22 bp, Artificial Sequence
  chemically synthesized
gcccttcaccttcggaaagcca

SEQ ID NO: 65708 - DNA, 22 bp, Artificial Sequence
  chemically synthesized
caccttcggaaagccaaaatga

SEQ ID NO: 65709 - DNA, 22 bp, Artificial Sequence
  chemically synthesized
accttcggaaagccaaaatgag

SEQ ID NO: 65710 - DNA, 22 bp, Artificial Sequence
  chemically synthesized
cggaaagccaaaatgagcacgg

SEQ ID NO: 65711 - DNA, 22 bp, Artificial Sequence
  chemically synthesized
ggaaagccaaaatgagcacggc

SEQ ID NO: 65712 - DNA, 22 bp, Artificial Sequence
  chemically synthesized
aagaggggattgacagcctttt

SEQ ID NO: 65713 - DNA, 22 bp, Artificial Sequence
  chemically synthesized
acagccttttctggaaaaaatg

SEQ ID NO: 65714 - DNA, 22 bp, Artificial Sequence
  chemically synthesized
ttctggaaaaaatggaagtttg

SEQ ID NO: 65715 - DNA, 22 bp, Artificial Sequence
  chemically synthesized
tctggaaaaaatggaagtttga

SEQ ID NO: 65716 - DNA, 22 bp, Artificial Sequence
  chemically synthesized
ctggaaaaaatggaagtttgaa

SEQ ID NO: 65717 - DNA, 22 bp, Artificial Sequence
  chemically synthesized
tggaaaaaatggaagtttgaat

SEQ ID NO: 65718 - DNA, 22 bp, Artificial Sequence
  chemically synthesized
gaaaaaatggaagtttgaatct

SEQ ID NO: 65719 - DNA, 22 bp, Artificial Sequence
  chemically synthesized
gaatctgaggaggtgtccctca

SEQ ID NO: 65720 - DNA, 22 bp, Artificial Sequence
  chemically synthesized
aatctgaggaggtgtccctcaa

SEQ ID NO: 65721 - DNA, 22 bp, Artificial Sequence
  chemically synthesized
aggaggtgtccctcaacaacag

SEQ ID NO: 65722 - DNA, 22 bp, Artificial Sequence
  chemically synthesized
aacaacaggtgctgctccccaa

SEQ ID NO: 65723 - DNA, 22 bp, Artificial Sequence
  chemically synthesized
ctccccaaatctggggccaaac

SEQ ID NO: 65724 - DNA, 22 bp, Artificial Sequence
  chemically synthesized
cccaaatctggggccaaacgca

SEQ ID NO: 65725 - DNA, 22 bp, Artificial Sequence
  chemically synthesized
gggccaaacgcagcagttgttc

SEQ ID NO: 65726 - DNA, 22 bp, Artificial Sequence
  chemically synthesized
ttcccccacttagacccctgag

SEQ ID NO: 65727 - DNA, 22 bp, Artificial Sequence
  chemically synthesized
ccccacttagacccctgagacc

SEQ ID NO: 65728 - DNA, 22 bp, Artificial Sequence
  chemically synthesized
agacccctgagacccatctata

SEQ ID NO: 65729 - DNA, 22 bp, Artificial Sequence
  chemically synthesized
gacccctgagacccatctatat

SEQ ID NO: 65730 - DNA, 22 bp, Artificial Sequence
  chemically synthesized
agacccatctatatggtttttc

SEQ ID NO: 65731 - DNA, 22 bp, Artificial Sequence
  chemically synthesized
tatggtttttcagagccaggac

SEQ ID NO: 65732 - DNA, 22 bp, Artificial Sequence
  chemically synthesized
ttcagagccaggacacatcccc

SEQ ID NO: 65733 - DNA, 22 bp, Artificial Sequence
  chemically synthesized
tcagagccaggacacatcccca

SEQ ID NO: 65734 - DNA, 22 bp, Artificial Sequence
  chemically synthesized
cagagccaggacacatccccaa

SEQ ID NO: 65735 - DNA, 22 bp, Artificial Sequence
  chemically synthesized
agagccaggacacatccccaaa

SEQ ID NO: 65736 - DNA, 22 bp, Artificial Sequence
  chemically synthesized
tggtggttagcattgacttggg

SEQ ID NO: 65737 - DNA, 22 bp, Artificial Sequence
  chemically synthesized
ggtggttagcattgacttgggg

SEQ ID NO: 65738 - DNA, 22 bp, Artificial Sequence
  chemically synthesized
gtggttagcattgacttggggc

SEQ ID NO: 65739 - DNA, 22 bp, Artificial Sequence
  chemically synthesized
gcattgacttggggcccatcac

SEQ ID NO: 65740 - DNA, 22 bp, Artificial Sequence
  chemically synthesized
acttggggcccatcacatgcca

SEQ ID NO: 65741 - DNA, 22 bp, Artificial Sequence
  chemically synthesized
ggggcccatcacatgccagagg

SEQ ID NO: 65742 - DNA, 22 bp, Artificial Sequence
  chemically synthesized
gggcccatcacatgccagaggc

SEQ ID NO: 65743 - DNA, 22 bp, Artificial Sequence
  chemically synthesized
cccgaagtgcttaaatgttatt

SEQ ID NO: 65744 - DNA, 22 bp, Artificial Sequence
  chemically synthesized
aaatgttattatctcattcgat

SEQ ID NO: 65745 - DNA, 22 bp, Artificial Sequence
  chemically synthesized
aatgttattatctcattcgatc

SEQ ID NO: 65746 - DNA, 22 bp, Artificial Sequence
  chemically synthesized
ttatctcattcgatcttcacag

SEQ ID NO: 65747 - DNA, 22 bp, Artificial Sequence
  chemically synthesized
tctcattcgatcttcacagtcc

SEQ ID NO: 65748 - DNA, 22 bp, Artificial Sequence
  chemically synthesized
attcgatcttcacagtcctgat

SEQ ID NO: 65749 - DNA, 22 bp, Artificial Sequence
  chemically synthesized
gatcttcacagtcctgatggaa

SEQ ID NO: 65750 - DNA, 22 bp, Artificial Sequence
  chemically synthesized
cacagtcctgatggaagtgact

SEQ ID NO: 65751 - DNA, 22 bp, Artificial Sequence
  chemically synthesized
acagtcctgatggaagtgactc

SEQ ID NO: 65752 - DNA, 22 bp, Artificial Sequence
  chemically synthesized
atggaagtgactcttcttagag

SEQ ID NO: 65753 - DNA, 22 bp, Artificial Sequence
  chemically synthesized
ttcttagagtcttcctatctca

SEQ ID NO: 65754 - DNA, 22 bp, Artificial Sequence
  chemically synthesized
cttagagtcttcctatctcaca

SEQ ID NO: 65755 - DNA, 22 bp, Artificial Sequence
  chemically synthesized
ttagagtcttcctatctcacag

SEQ ID NO: 65756 - DNA, 22 bp, Artificial Sequence
  chemically synthesized
agagtcttcctatctcacagat

SEQ ID NO: 65757 - DNA, 22 bp, Artificial Sequence
  chemically synthesized
gagtcttcctatctcacagatg

SEQ ID NO: 65758 - DNA, 22 bp, Artificial Sequence
  chemically synthesized
cctatctcacagatgaggaaac

SEQ ID NO: 65759 - DNA, 22 bp, Artificial Sequence
  chemically synthesized
ctatctcacagatgaggaaacc

SEQ ID NO: 65760 - DNA, 22 bp, Artificial Sequence
  chemically synthesized
tctcacagatgaggaaaccgag

SEQ ID NO: 65761 - DNA, 22 bp, Artificial Sequence
  chemically synthesized
acagatgaggaaaccgaggcac

SEQ ID NO: 65762 - DNA, 22 bp, Artificial Sequence
  chemically synthesized
agtggcttgtctaagagctcac

SEQ ID NO: 65763 - DNA, 22 bp, Artificial Sequence
  chemically synthesized
gtctaagagctcacaaaaagag

SEQ ID NO: 65764 - DNA, 22 bp, Artificial Sequence
  chemically synthesized
tctaagagctcacaaaaagagc

SEQ ID NO: 65765 - DNA, 22 bp, Artificial Sequence
  chemically synthesized
agagctcacaaaaagagcgatg

SEQ ID NO: 65766 - DNA, 22 bp, Artificial Sequence
  chemically synthesized
acaaaaagagcgatggagctaa

SEQ ID NO: 65767 - DNA, 22 bp, Artificial Sequence
  chemically synthesized
aggcttggccccagatattaga

SEQ ID NO: 65768 - DNA, 22 bp, Artificial Sequence
  chemically synthesized
ggccccagatattagatcccga

SEQ ID NO: 65769 - DNA, 22 bp, Artificial Sequence
  chemically synthesized
gccccagatattagatcccgaa

SEQ ID NO: 65770 - DNA, 22 bp, Artificial Sequence
  chemically synthesized
gatcccgaacccacgccttaac

SEQ ID NO: 65771 - DNA, 22 bp, Artificial Sequence
  chemically synthesized
aaccagtgacctgcactgactc

SEQ ID NO: 65772 - DNA, 22 bp, Artificial Sequence
  chemically synthesized
accagtgacctgcactgactct

SEQ ID NO: 65773 - DNA, 22 bp, Artificial Sequence
  chemically synthesized
cactgactctcaaagaaggaag

SEQ ID NO: 65774 - DNA, 22 bp, Artificial Sequence
  chemically synthesized
actctcaaagaaggaagctggt

SEQ ID NO: 65775 - DNA, 22 bp, Artificial Sequence
  chemically synthesized
tcaaagaaggaagctggtgcct

SEQ ID NO: 65776 - DNA, 22 bp, Artificial Sequence
  chemically synthesized
aaagaaggaagctggtgcctgg

SEQ ID NO: 65777 - DNA, 22 bp, Artificial Sequence
  chemically synthesized
gtgcctgggaaggagggtgcat

SEQ ID NO: 65778 - DNA, 22 bp, Artificial Sequence
  chemically synthesized
ggaaggagggtgcatagtgagg

SEQ ID NO: 65779 - DNA, 22 bp, Artificial Sequence
  chemically synthesized
gtggggtggccagcactctccg

SEQ ID NO: 65780 - DNA, 22 bp, Artificial Sequence
  chemically synthesized
tggggtggccagcactctccgg

SEQ ID NO: 65781 - DNA, 22 bp, Artificial Sequence
  chemically synthesized
tccgggggcactttgccaatga

SEQ ID NO: 65782 - DNA, 22 bp, Artificial Sequence
  chemically synthesized
cgggggcactttgccaatgagt

SEQ ID NO: 65783 - DNA, 22 bp, Artificial Sequence
  chemically synthesized
tgccaatgagttcagctcccat

SEQ ID NO: 65784 - DNA, 22 bp, Artificial Sequence
  chemically synthesized
gccaatgagttcagctcccatg

SEQ ID NO: 65785 - DNA, 22 bp, Artificial Sequence
  chemically synthesized
ccaatgagttcagctcccatga

SEQ ID NO: 65786 - DNA, 22 bp, Artificial Sequence
  chemically synthesized
agctcccatgaagtccactgtt

SEQ ID NO: 65787 - DNA, 22 bp, Artificial Sequence
  chemically synthesized
ccatgaagtccactgttgttct

SEQ ID NO: 65788 - DNA, 22 bp, Artificial Sequence
  chemically synthesized
ttgttctcctgaccagccactc

SEQ ID NO: 65789 - DNA, 22 bp, Artificial Sequence
  chemically synthesized
ttctcctgaccagccactcagt

SEQ ID NO: 65790 - DNA, 22 bp, Artificial Sequence
  chemically synthesized
tcctgaccagccactcagtctt

SEQ ID NO: 65791 - DNA, 22 bp, Artificial Sequence
  chemically synthesized
ctgaccagccactcagtcttga

SEQ ID NO: 65792 - DNA, 22 bp, Artificial Sequence
  chemically synthesized
accagccactcagtcttgattt

SEQ ID NO: 65793 - DNA, 22 bp, Artificial Sequence
  chemically synthesized
agtcttgatttacttggcccag

SEQ ID NO: 65794 - DNA, 22 bp, Artificial Sequence
  chemically synthesized
gatttacttggcccagggccac

SEQ ID NO: 65795 - DNA, 22 bp, Artificial Sequence
  chemically synthesized
atttacttggcccagggccact

SEQ ID NO: 65796 - DNA, 22 bp, Artificial Sequence
  chemically synthesized
acttggcccagggccactggca

SEQ ID NO: 65797 - DNA, 22 bp, Artificial Sequence
  chemically synthesized
cttggcccagggccactggcac

SEQ ID NO: 65798 - DNA, 22 bp, Artificial Sequence
  chemically synthesized
ggcccagggccactggcacacc

SEQ ID NO: 65799 - DNA, 22 bp, Artificial Sequence
  chemically synthesized
gcccagggccactggcacacct

SEQ ID NO: 65800 - DNA, 22 bp, Artificial Sequence
  chemically synthesized
gcacacctcacccccttacccg

SEQ ID NO: 65801 - DNA, 22 bp, Artificial Sequence
  chemically synthesized
acccccttacccgattccttgc

SEQ ID NO: 65802 - DNA, 22 bp, Artificial Sequence
  chemically synthesized
acccgattccttgctgcagacc

SEQ ID NO: 65803 - DNA, 22 bp, Artificial Sequence
  chemically synthesized
cccgattccttgctgcagaccc

SEQ ID NO: 65804 - DNA, 22 bp, Artificial Sequence
  chemically synthesized
cttgctgcagaccccaaatctc

SEQ ID NO: 65805 - DNA, 22 bp, Artificial Sequence
  chemically synthesized
gctgcagaccccaaatctcgac

SEQ ID NO: 65806 - DNA, 22 bp, Artificial Sequence
  chemically synthesized
ctgcagaccccaaatctcgact

SEQ ID NO: 65807 - DNA, 22 bp, Artificial Sequence
  chemically synthesized
cagaccccaaatctcgactctc

SEQ ID NO: 65808 - DNA, 22 bp, Artificial Sequence
  chemically synthesized
gactctcacatccctatccagc

SEQ ID NO: 65809 - DNA, 22 bp, Artificial Sequence
  chemically synthesized
tcacatccctatccagcccata

SEQ ID NO: 65810 - DNA, 22 bp, Artificial Sequence
  chemically synthesized
acatccctatccagcccatacc

SEQ ID NO: 65811 - DNA, 22 bp, Artificial Sequence
  chemically synthesized
tccagcccataccacgaggctc

SEQ ID NO: 65812 - DNA, 22 bp, Artificial Sequence
  chemically synthesized
ccatctccaggcagggccctgt

SEQ ID NO: 65813 - DNA, 22 bp, Artificial Sequence
  chemically synthesized
caggcagggccctgtggtgggg

SEQ ID NO: 65814 - DNA, 22 bp, Artificial Sequence
  chemically synthesized
tggtggggcagggcctccccca

SEQ ID NO: 65815 - DNA, 22 bp, Artificial Sequence
  chemically synthesized
ccccagatgccccttactcatg

SEQ ID NO: 65816 - DNA, 22 bp, Artificial Sequence
  chemically synthesized
actcatgaccagctcacaggat

SEQ ID NO: 65817 - DNA, 22 bp, Artificial Sequence
  chemically synthesized
ctcatgaccagctcacaggatc

SEQ ID NO: 65818 - DNA, 22 bp, Artificial Sequence
  chemically synthesized
atgaccagctcacaggatcttc

SEQ ID NO: 65819 - DNA, 22 bp, Artificial Sequence
  chemically synthesized
acaggatcttcccatgatgcat

SEQ ID NO: 65820 - DNA, 22 bp, Artificial Sequence
  chemically synthesized
cccatgatgcatttcctctggg

SEQ ID NO: 65821 - DNA, 22 bp, Artificial Sequence
  chemically synthesized
ccatgatgcatttcctctgggg

SEQ ID NO: 65822 - DNA, 22 bp, Artificial Sequence
  chemically synthesized
cctctggggggatcagcccaga

SEQ ID NO: 65823 - DNA, 22 bp, Artificial Sequence
  chemically synthesized
ctctggggggatcagcccagat

SEQ ID NO: 65824 - DNA, 22 bp, Artificial Sequence
  chemically synthesized
tggggggatcagcccagatgct

SEQ ID NO: 65825 - DNA, 22 bp, Artificial Sequence
  chemically synthesized
gggggatcagcccagatgctgc

SEQ ID NO: 65826 - DNA, 22 bp, Artificial Sequence
  chemically synthesized
caatagacaattgtggaagtaa

SEQ ID NO: 65827 - DNA, 22 bp, Artificial Sequence
  chemically synthesized
tggaagtaaccaggtggacaag

SEQ ID NO: 65828 - DNA, 22 bp, Artificial Sequence
  chemically synthesized
tccccctcatgtcctggggttc

SEQ ID NO: 65829 - DNA, 22 bp, Artificial Sequence
  chemically synthesized
ccccctcatgtcctggggttcc

SEQ ID NO: 65830 - DNA, 22 bp, Artificial Sequence
  chemically synthesized
cccctcatgtcctggggttcct

SEQ ID NO: 65831 - DNA, 22 bp, Artificial Sequence
  chemically synthesized
atgtcctggggttcctgggggc

SEQ ID NO: 65832 - DNA, 22 bp, Artificial Sequence
  chemically synthesized
gggttcctgggggcacagtatc

SEQ ID NO: 65833 - DNA, 22 bp, Artificial Sequence
  chemically synthesized
ctgggggcacagtatccttgtg

SEQ ID NO: 65834 - DNA, 22 bp, Artificial Sequence
  chemically synthesized
ggggcacagtatccttgtgaat

SEQ ID NO: 65835 - DNA, 22 bp, Artificial Sequence
  chemically synthesized
gtgaatggccactgagtactcc

SEQ ID NO: 65836 - DNA, 22 bp, Artificial Sequence
  chemically synthesized
tgaatggccactgagtactccc

SEQ ID NO: 65837 - DNA, 22 bp, Artificial Sequence
  chemically synthesized
agtactcccacccctcccacca

SEQ ID NO: 65838 - DNA, 22 bp, Artificial Sequence
  chemically synthesized
ccacccctcccaccacaacccc

SEQ ID NO: 65839 - DNA, 22 bp, Artificial Sequence
  chemically synthesized
ccaccacaacccccgggatttt

SEQ ID NO: 65840 - DNA, 22 bp, Artificial Sequence
  chemically synthesized
tgtcctggtgcgtttttccaga

SEQ ID NO: 65841 - DNA, 22 bp, Artificial Sequence
  chemically synthesized
gtcctggtgcgtttttccagat

SEQ ID NO: 65842 - DNA, 22 bp, Artificial Sequence
  chemically synthesized
tcctggtgcgtttttccagatt

SEQ ID NO: 65843 - DNA, 22 bp, Artificial Sequence
  chemically synthesized
gtgcgtttttccagattatcct

SEQ ID NO: 65844 - DNA, 22 bp, Artificial Sequence
  chemically synthesized
ttccagattatcctagcccttc

SEQ ID NO: 65845 - DNA, 22 bp, Artificial Sequence
  chemically synthesized
tccagattatcctagcccttcc

SEQ ID NO: 65846 - DNA, 22 bp, Artificial Sequence
  chemically synthesized
ccagattatcctagcccttcct

SEQ ID NO: 65847 - DNA, 22 bp, Artificial Sequence
  chemically synthesized
cagattatcctagcccttcctc

SEQ ID NO: 65848 - DNA, 22 bp, Artificial Sequence
  chemically synthesized
tcctagcccttcctcccaggat

SEQ ID NO: 65849 - DNA, 22 bp, Artificial Sequence
  chemically synthesized
gcccttcctcccaggatggatg

SEQ ID NO: 65850 - DNA, 22 bp, Artificial Sequence
  chemically synthesized
cctcccaggatggatgtccaga

SEQ ID NO: 65851 - DNA, 22 bp, Artificial Sequence
  chemically synthesized
ctcccaggatggatgtccagag

SEQ ID NO: 65852 - DNA, 22 bp, Artificial Sequence
  chemically synthesized
ccaggatggatgtccagagcag

SEQ ID NO: 65853 - DNA, 22 bp, Artificial Sequence
  chemically synthesized
agcctagagccctgccaaaaga

SEQ ID NO: 65854 - DNA, 22 bp, Artificial Sequence
  chemically synthesized
gagccctgccaaaagagcagga

SEQ ID NO: 65855 - DNA, 22 bp, Artificial Sequence
  chemically synthesized
ccaaaagagcaggaccccaaat

SEQ ID NO: 65856 - DNA, 22 bp, Artificial Sequence
  chemically synthesized
tgagccccttacttgcctcacc

SEQ ID NO: 65857 - DNA, 22 bp, Artificial Sequence
  chemically synthesized
agccccttacttgcctcacctg

SEQ ID NO: 65858 - DNA, 22 bp, Artificial Sequence
  chemically synthesized
acttgcctcacctgctcccacc

SEQ ID NO: 65859 - DNA, 22 bp, Artificial Sequence
  chemically synthesized
cttgcctcacctgctcccaccc

SEQ ID NO: 65860 - DNA, 22 bp, Artificial Sequence
  chemically synthesized
gcctcacctgctcccacccatg

SEQ ID NO: 65861 - DNA, 22 bp, Artificial Sequence
  chemically synthesized
cctcacctgctcccacccatgc

SEQ ID NO: 65862 - DNA, 22 bp, Artificial Sequence
  chemically synthesized
acctgctcccacccatgctttc

SEQ ID NO: 65863 - DNA, 22 bp, Artificial Sequence
  chemically synthesized
ctcccacccatgctttcttcat

SEQ ID NO: 65864 - DNA, 22 bp, Artificial Sequence
  chemically synthesized
ccacccatgctttcttcattcc

SEQ ID NO: 65865 - DNA, 22 bp, Artificial Sequence
  chemically synthesized
tcttcattcctcctccaaaagc

SEQ ID NO: 65866 - DNA, 22 bp, Artificial Sequence
  chemically synthesized
cttcattcctcctccaaaagcc

SEQ ID NO: 65867 - DNA, 22 bp, Artificial Sequence
  chemically synthesized
ttcattcctcctccaaaagccc

SEQ ID NO: 65868 - DNA, 22 bp, Artificial Sequence
  chemically synthesized
cattcctcctccaaaagcccca

SEQ ID NO: 65869 - DNA, 22 bp, Artificial Sequence
  chemically synthesized
attcctcctccaaaagccccag

SEQ ID NO: 65870 - DNA, 22 bp, Artificial Sequence
  chemically synthesized
ctcctccaaaagccccagctcc

SEQ ID NO: 65871 - DNA, 22 bp, Artificial Sequence
  chemically synthesized
ctccaaaagccccagctcccca

SEQ ID NO: 65872 - DNA, 22 bp, Artificial Sequence
  chemically synthesized
caaaagccccagctccccactg

SEQ ID NO: 65873 - DNA, 22 bp, Artificial Sequence
  chemically synthesized
cccactgcaatcccttctgcac

SEQ ID NO: 65874 - DNA, 22 bp, Artificial Sequence
  chemically synthesized
caatcccttctgcacccagcca

SEQ ID NO: 65875 - DNA, 22 bp, Artificial Sequence
  chemically synthesized
ctgcacccagccaggtcctatg

SEQ ID NO: 65876 - DNA, 22 bp, Artificial Sequence
  chemically synthesized
tgcacccagccaggtcctatga

SEQ ID NO: 65877 - DNA, 22 bp, Artificial Sequence
  chemically synthesized
cacccagccaggtcctatgaca

SEQ ID NO: 65878 - DNA, 22 bp, Artificial Sequence
  chemically synthesized
tgacacacacctccccagtgca

SEQ ID NO: 65879 - DNA, 22 bp, Artificial Sequence
  chemically synthesized
cccagtgcacacagacctgccc

SEQ ID NO: 65880 - DNA, 22 bp, Artificial Sequence
  chemically synthesized
cccaactgtggggctgcccact

SEQ ID NO: 65881 - DNA, 22 bp, Artificial Sequence
  chemically synthesized
tggggctgcccactgggcattt

SEQ ID NO: 65882 - DNA, 22 bp, Artificial Sequence
  chemically synthesized
cccactgggcatttcataggtg

SEQ ID NO: 65883 - DNA, 22 bp, Artificial Sequence
  chemically synthesized
ggcatttcataggtggctcagt

SEQ ID NO: 65884 - DNA, 22 bp, Artificial Sequence
  chemically synthesized
cataggtggctcagtcctcttc

SEQ ID NO: 65885 - DNA, 22 bp, Artificial Sequence
  chemically synthesized
ataggtggctcagtcctcttcc

SEQ ID NO: 65886 - DNA, 22 bp, Artificial Sequence
  chemically synthesized
agtcctcttccctctgcagctg

SEQ ID NO: 65887 - DNA, 22 bp, Artificial Sequence
  chemically synthesized
ttccctctgcagctggccccag

SEQ ID NO: 65888 - DNA, 22 bp, Artificial Sequence
  chemically synthesized
ccctctgcagctggccccagaa

SEQ ID NO: 65889 - DNA, 22 bp, Artificial Sequence
  chemically synthesized
cctctgcagctggccccagaaa

SEQ ID NO: 65890 - DNA, 22 bp, Artificial Sequence
  chemically synthesized
tgcagctggccccagaaacctg

SEQ ID NO: 65891 - DNA, 22 bp, Artificial Sequence
  chemically synthesized
cagctggccccagaaacctgcc

SEQ ID NO: 65892 - DNA, 22 bp, Artificial Sequence
  chemically synthesized
gccccagaaacctgccagttat

SEQ ID NO: 65893 - DNA, 22 bp, Artificial Sequence
  chemically synthesized
ccagttattggtgccaggtctg

SEQ ID NO: 65894 - DNA, 22 bp, Artificial Sequence
  chemically synthesized
ttggtgccaggtctgtgccagg

SEQ ID NO: 65895 - DNA, 22 bp, Artificial Sequence
  chemically synthesized
gtgccaggtctgtgccaggagg

SEQ ID NO: 65896 - DNA, 22 bp, Artificial Sequence
  chemically synthesized
tgccaggagggcgaggcctgtc

SEQ ID NO: 65897 - DNA, 22 bp, Artificial Sequence
  chemically synthesized
tcatttctagtaatcctctggg

SEQ ID NO: 65898 - DNA, 22 bp, Artificial Sequence
  chemically synthesized
ctagtaatcctctgggcagtgt

SEQ ID NO: 65899 - DNA, 22 bp, Artificial Sequence
  chemically synthesized
tagtaatcctctgggcagtgtg

SEQ ID NO: 65900 - DNA, 22 bp, Artificial Sequence
  chemically synthesized
gtaatcctctgggcagtgtgac

SEQ ID NO: 65901 - DNA, 22 bp, Artificial Sequence
  chemically synthesized
tgggcagtgtgactgtacctct

SEQ ID NO: 65902 - DNA, 22 bp, Artificial Sequence
  chemically synthesized
ggcagtgtgactgtacctcttg

SEQ ID NO: 65903 - DNA, 22 bp, Artificial Sequence
  chemically synthesized
tacctcttgcggcaactcaaag

SEQ ID NO: 65904 - DNA, 22 bp, Artificial Sequence
  chemically synthesized
ttgcggcaactcaaagggagag

SEQ ID NO: 65905 - DNA, 22 bp, Artificial Sequence
  chemically synthesized
gcggcaactcaaagggagaggg

SEQ ID NO: 65906 - DNA, 22 bp, Artificial Sequence
  chemically synthesized
cggcaactcaaagggagagggt

SEQ ID NO: 65907 - DNA, 22 bp, Artificial Sequence
  chemically synthesized
aaagggagagggtgacttgtcc

SEQ ID NO: 65908 - DNA, 22 bp, Artificial Sequence
  chemically synthesized
gtcccgggtcacagagctgaaa

SEQ ID NO: 65909 - DNA, 22 bp, Artificial Sequence
  chemically synthesized
tcccgggtcacagagctgaaag

SEQ ID NO: 65910 - DNA, 22 bp, Artificial Sequence
  chemically synthesized
aaagggcaggtacaacaggtga

SEQ ID NO: 65911 - DNA, 22 bp, Artificial Sequence
  chemically synthesized
tctgagtttatgagggcccagt

SEQ ID NO: 65912 - DNA, 22 bp, Artificial Sequence
  chemically synthesized
agtttatgagggcccagtcttg

SEQ ID NO: 65913 - DNA, 22 bp, Artificial Sequence
  chemically synthesized
atgagggcccagtcttgtgtct

SEQ ID NO: 65914 - DNA, 22 bp, Artificial Sequence
  chemically synthesized
tgagggcccagtcttgtgtctg

SEQ ID NO: 65915 - DNA, 22 bp, Artificial Sequence
  chemically synthesized
gtgtctgccgggcaatgagcaa

SEQ ID NO: 65916 - DNA, 22 bp, Artificial Sequence
  chemically synthesized
tgtctgccgggcaatgagcaag

SEQ ID NO: 65917 - DNA, 22 bp, Artificial Sequence
  chemically synthesized
ccgggcaatgagcaaggctcct

SEQ ID NO: 65918 - DNA, 22 bp, Artificial Sequence
  chemically synthesized
cttcctgtccaagctccccgcc

SEQ ID NO: 65919 - DNA, 22 bp, Artificial Sequence
  chemically synthesized
cctgtccaagctccccgcccct

SEQ ID NO: 65920 - DNA, 22 bp, Artificial Sequence
  chemically synthesized
ctgtccaagctccccgcccctc

SEQ ID NO: 65921 - DNA, 22 bp, Artificial Sequence
  chemically synthesized
tccaagctccccgcccctcccc

SEQ ID NO: 65922 - DNA, 22 bp, Artificial Sequence
  chemically synthesized
cccgcccctccccagcctactg

SEQ ID NO: 65923 - DNA, 22 bp, Artificial Sequence
  chemically synthesized
cccagcctactgcctccacccg

SEQ ID NO: 65924 - DNA, 22 bp, Artificial Sequence
  chemically synthesized
ctgcctccacccgaagtctact

SEQ ID NO: 65925 - DNA, 22 bp, Artificial Sequence
  chemically synthesized
cctccacccgaagtctacttcc

SEQ ID NO: 65926 - DNA, 22 bp, Artificial Sequence
  chemically synthesized
cacccgaagtctacttcctggg

SEQ ID NO: 65927 - DNA, 22 bp, Artificial Sequence
  chemically synthesized
cttcctgggtgggcaggaactg

SEQ ID NO: 65928 - DNA, 22 bp, Artificial Sequence
  chemically synthesized
cctgggtgggcaggaactgggc

SEQ ID NO: 65929 - DNA, 22 bp, Artificial Sequence
  chemically synthesized
ctgggtgggcaggaactgggca

SEQ ID NO: 65930 - DNA, 22 bp, Artificial Sequence
  chemically synthesized
ggtgggcaggaactgggcactg

SEQ ID NO: 65931 - DNA, 22 bp, Artificial Sequence
  chemically synthesized
ggcactgtgcccagggcatgca

SEQ ID NO: 65932 - DNA, 22 bp, Artificial Sequence
  chemically synthesized
tgcccagggcatgcactgcctc

SEQ ID NO: 65933 - DNA, 22 bp, Artificial Sequence
  chemically synthesized
cctccacgcagcaaccctcaga

SEQ ID NO: 65934 - DNA, 22 bp, Artificial Sequence
  chemically synthesized
cacgcagcaaccctcagagtcc

SEQ ID NO: 65935 - DNA, 22 bp, Artificial Sequence
  chemically synthesized
agagtcctgagctgaaccaaga

SEQ ID NO: 65936 - DNA, 22 bp, Artificial Sequence
  chemically synthesized
agctgaaccaagaaggaggagg

SEQ ID NO: 65937 - DNA, 22 bp, Artificial Sequence
  chemically synthesized
aaccaagaaggaggagggggtc

SEQ ID NO: 65938 - DNA, 22 bp, Artificial Sequence
  chemically synthesized
cgaggaaggcctagccgctgct

SEQ ID NO: 65939 - DNA, 22 bp, Artificial Sequence
  chemically synthesized
gccgctgctgctgccaggaatt

SEQ ID NO: 65940 - DNA, 22 bp, Artificial Sequence
  chemically synthesized
ctgctgccaggaattccaggtt

SEQ ID NO: 65941 - DNA, 22 bp, Artificial Sequence
  chemically synthesized
ctgccaggaattccaggttgga

SEQ ID NO: 65942 - DNA, 22 bp, Artificial Sequence
  chemically synthesized
ccaggaattccaggttggaggg

SEQ ID NO: 65943 - DNA, 22 bp, Artificial Sequence
  chemically synthesized
caggttggaggggcggcaacct

SEQ ID NO: 65944 - DNA, 22 bp, Artificial Sequence
  chemically synthesized
gaggggcggcaacctcctgcca

SEQ ID NO: 65945 - DNA, 22 bp, Artificial Sequence
  chemically synthesized
ctgccagccttcaggccactct

SEQ ID NO: 65946 - DNA, 22 bp, Artificial Sequence
  chemically synthesized
ccagccttcaggccactctcct

SEQ ID NO: 65947 - DNA, 22 bp, Artificial Sequence
  chemically synthesized
caggccactctcctgtgcctgc

SEQ ID NO: 65948 - DNA, 22 bp, Artificial Sequence
  chemically synthesized
aggccactctcctgtgcctgcc

SEQ ID NO: 65949 - DNA, 22 bp, Artificial Sequence
  chemically synthesized
tcctgtgcctgccagaagagac

SEQ ID NO: 65950 - DNA, 22 bp, Artificial Sequence
  chemically synthesized
ctgtgcctgccagaagagacag

SEQ ID NO: 65951 - DNA, 22 bp, Artificial Sequence
  chemically synthesized
tgcctgccagaagagacagagc

SEQ ID NO: 65952 - DNA, 22 bp, Artificial Sequence
  chemically synthesized
ccagaagagacagagcttgagg

SEQ ID NO: 65953 - DNA, 22 bp, Artificial Sequence
  chemically synthesized
gaggagagcttgaggagagcag

SEQ ID NO: 65954 - DNA, 22 bp, Artificial Sequence
  chemically synthesized
aggagagcttgaggagagcagg

SEQ ID NO: 65955 - DNA, 22 bp, Artificial Sequence
  chemically synthesized
gaggagagcaggaaaggtggga

SEQ ID NO: 65956 - DNA, 22 bp, Artificial Sequence
  chemically synthesized
aggagagcaggaaaggtgggac

SEQ ID NO: 65957 - DNA, 22 bp, Artificial Sequence
  chemically synthesized
ctgctgctgctcactcagttcc

SEQ ID NO: 65958 - DNA, 22 bp, Artificial Sequence
  chemically synthesized
ctgctgctcactcagttccaca

SEQ ID NO: 65959 - DNA, 22 bp, Artificial Sequence
  chemically synthesized
ctgctcactcagttccacaggt

SEQ ID NO: 65960 - DNA, 22 bp, Artificial Sequence
  chemically synthesized
ctcactcagttccacaggtggg

SEQ ID NO: 65961 - DNA, 22 bp, Artificial Sequence
  chemically synthesized
actcagttccacaggtgggagg

SEQ ID NO: 65962 - DNA, 22 bp, Artificial Sequence
  chemically synthesized
agttccacaggtgggagggaca

SEQ ID NO: 65963 - DNA, 22 bp, Artificial Sequence
  chemically synthesized
cacaggtgggagggacagcagg

SEQ ID NO: 65964 - DNA, 22 bp, Artificial Sequence
  chemically synthesized
agagtgggggtcattgtgcaga

SEQ ID NO: 65965 - DNA, 22 bp, Artificial Sequence
  chemically synthesized
gagtgggggtcattgtgcagat

SEQ ID NO: 65966 - DNA, 22 bp, Artificial Sequence
  chemically synthesized
tgcagatgggaaaacaaaggcc

SEQ ID NO: 65967 - DNA, 22 bp, Artificial Sequence
  chemically synthesized
ccgagggcaggcgacctcaacc

SEQ ID NO: 65968 - DNA, 22 bp, Artificial Sequence
  chemically synthesized
aaccacagcccagtgctggagc

SEQ ID NO: 65969 - DNA, 22 bp, Artificial Sequence
  chemically synthesized
gagctgtgagtggatgtagagc

SEQ ID NO: 65970 - DNA, 22 bp, Artificial Sequence
  chemically synthesized
tgagtggatgtagagcagcgga

SEQ ID NO: 65971 - DNA, 22 bp, Artificial Sequence
  chemically synthesized
agccagctcaggggaaggacag

SEQ ID NO: 65972 - DNA, 22 bp, Artificial Sequence
  chemically synthesized
aggggaaggacaggggccctga

SEQ ID NO: 65973 - DNA, 22 bp, Artificial Sequence
  chemically synthesized
aagccaggggatggagctgcag

SEQ ID NO: 65974 - DNA, 22 bp, Artificial Sequence
  chemically synthesized
cagggaagggagctcagagaga

SEQ ID NO: 65975 - DNA, 22 bp, Artificial Sequence
  chemically synthesized
agagagaaggggaggggagtct

SEQ ID NO: 65976 - DNA, 22 bp, Artificial Sequence
  chemically synthesized
agctcagtttcccgctgcctga

SEQ ID NO: 65977 - DNA, 22 bp, Artificial Sequence
  chemically synthesized
agtttcccgctgcctgaaagga

SEQ ID NO: 65978 - DNA, 22 bp, Artificial Sequence
  chemically synthesized
cccgctgcctgaaaggagggtg

SEQ ID NO: 65979 - DNA, 22 bp, Artificial Sequence
  chemically synthesized
ccgctgcctgaaaggagggtgg

SEQ ID NO: 65980 - DNA, 22 bp, Artificial Sequence
  chemically synthesized
cctgaaaggagggtggtaccta

SEQ ID NO: 65981 - DNA, 22 bp, Artificial Sequence
  chemically synthesized
aaaggagggtggtacctactcc

SEQ ID NO: 65982 - DNA, 22 bp, Artificial Sequence
  chemically synthesized
ctcccttcacagggtaactgaa

SEQ ID NO: 65983 - DNA, 22 bp, Artificial Sequence
  chemically synthesized
ccttcacagggtaactgaatga

SEQ ID NO: 65984 - DNA, 22 bp, Artificial Sequence
  chemically synthesized
cacagggtaactgaatgagaga

SEQ ID NO: 65985 - DNA, 22 bp, Artificial Sequence
  chemically synthesized
acagggtaactgaatgagagac

SEQ ID NO: 65986 - DNA, 22 bp, Artificial Sequence
  chemically synthesized
aatgagagactgcctggaggaa

SEQ ID NO: 65987 - DNA, 22 bp, Artificial Sequence
  chemically synthesized
cctggaggaaagctcttcaagt

SEQ ID NO: 65988 - DNA, 22 bp, Artificial Sequence
  chemically synthesized
gaggaaagctcttcaagtgtgg

SEQ ID NO: 65989 - DNA, 22 bp, Artificial Sequence
  chemically synthesized
ttcaagtgtggcccaccccacc

SEQ ID NO: 65990 - DNA, 22 bp, Artificial Sequence
  chemically synthesized
caagtgtggcccaccccacccc

SEQ ID NO: 65991 - DNA, 22 bp, Artificial Sequence
  chemically synthesized
aagtgtggcccaccccacccca

SEQ ID NO: 65992 - DNA, 22 bp, Artificial Sequence
  chemically synthesized
acacgggggagggagggcagca

SEQ ID NO: 65993 - DNA, 22 bp, Artificial Sequence
  chemically synthesized
tctgggcacacccagtacccgt

SEQ ID NO: 65994 - DNA, 22 bp, Artificial Sequence
  chemically synthesized
ctgggcacacccagtacccgtc

SEQ ID NO: 65995 - DNA, 22 bp, Artificial Sequence
  chemically synthesized
tgggcacacccagtacccgtct

SEQ ID NO: 65996 - DNA, 22 bp, Artificial Sequence
  chemically synthesized
ggcacacccagtacccgtctct

SEQ ID NO: 65997 - DNA, 22 bp, Artificial Sequence
  chemically synthesized
tgagctttccttgaactgttgc

SEQ ID NO: 65998 - DNA, 22 bp, Artificial Sequence
  chemically synthesized
agctttccttgaactgttgcat

SEQ ID NO: 65999 - DNA, 22 bp, Artificial Sequence
  chemically synthesized
tccttgaactgttgcattttaa

SEQ ID NO: 66000 - DNA, 22 bp, Artificial Sequence
  chemically synthesized
ccttgaactgttgcattttaat

SEQ ID NO: 66001 - DNA, 22 bp, Artificial Sequence
  chemically synthesized
cttgaactgttgcattttaatc

SEQ ID NO: 66002 - DNA, 22 bp, Artificial Sequence
  chemically synthesized
gaactgttgcattttaatcctc

SEQ ID NO: 66003 - DNA, 22 bp, Artificial Sequence
  chemically synthesized
aactgttgcattttaatcctca

SEQ ID NO: 66004 - DNA, 22 bp, Artificial Sequence
  chemically synthesized
ttgcattttaatcctcacagca

SEQ ID NO: 66005 - DNA, 22 bp, Artificial Sequence
  chemically synthesized
cattttaatcctcacagcagct

SEQ ID NO: 66006 - DNA, 22 bp, Artificial Sequence
  chemically synthesized
taatcctcacagcagctcaaca

SEQ ID NO: 66007 - DNA, 22 bp, Artificial Sequence
  chemically synthesized
aatcctcacagcagctcaacaa

SEQ ID NO: 66008 - DNA, 22 bp, Artificial Sequence
  chemically synthesized
atcctcacagcagctcaacaag

SEQ ID NO: 66009 - DNA, 22 bp, Artificial Sequence
  chemically synthesized
acagcagctcaacaaggtacat

SEQ ID NO: 66010 - DNA, 22 bp, Artificial Sequence
  chemically synthesized
aacaaggtacataccgtcacca

SEQ ID NO: 66011 - DNA, 22 bp, Artificial Sequence
  chemically synthesized
tacagatagggaaattgaggct

SEQ ID NO: 66012 - DNA, 22 bp, Artificial Sequence
  chemically synthesized
acagatagggaaattgaggctc

SEQ ID NO: 66013 - DNA, 22 bp, Artificial Sequence
  chemically synthesized
cagatagggaaattgaggctcg

SEQ ID NO: 66014 - DNA, 22 bp, Artificial Sequence
  chemically synthesized
aggctcggagcggttaaacaac

SEQ ID NO: 66015 - DNA, 22 bp, Artificial Sequence
  chemically synthesized
ggagcggttaaacaactcacct

SEQ ID NO: 66016 - DNA, 22 bp, Artificial Sequence
  chemically synthesized
aacaactcacctgaggcctcac

SEQ ID NO: 66017 - DNA, 22 bp, Artificial Sequence
  chemically synthesized
acctgaggcctcacagccagta

SEQ ID NO: 66018 - DNA, 22 bp, Artificial Sequence
  chemically synthesized
aggcctcacagccagtaagtgg

SEQ ID NO: 66019 - DNA, 22 bp, Artificial Sequence
  chemically synthesized
acagccagtaagtgggttccct

SEQ ID NO: 66020 - DNA, 22 bp, Artificial Sequence
  chemically synthesized
cctggtctgaatgtgtgtgctg

SEQ ID NO: 66021 - DNA, 22 bp, Artificial Sequence
  chemically synthesized
gtctgaatgtgtgtgctggagg

SEQ ID NO: 66022 - DNA, 22 bp, Artificial Sequence
  chemically synthesized
aatgtgtgtgctggaggatcct

SEQ ID NO: 66023 - DNA, 22 bp, Artificial Sequence
  chemically synthesized
gaggatcctgtgggtcactcgc

SEQ ID NO: 66024 - DNA, 22 bp, Artificial Sequence
  chemically synthesized
tgggtcactcgcctggtagagc

SEQ ID NO: 66025 - DNA, 22 bp, Artificial Sequence
  chemically synthesized
gcctggtagagccccaaggtgg

SEQ ID NO: 66026 - DNA, 22 bp, Artificial Sequence
  chemically synthesized
gtagagccccaaggtggaggca

SEQ ID NO: 66027 - DNA, 22 bp, Artificial Sequence
  chemically synthesized
gtgaatgacagaaggggcaaaa

SEQ ID NO: 66028 - DNA, 22 bp, Artificial Sequence
  chemically synthesized
atccattcactctgcaagtatc

SEQ ID NO: 66029 - DNA, 22 bp, Artificial Sequence
  chemically synthesized
actctgcaagtatctacggcac

SEQ ID NO: 66030 - DNA, 22 bp, Artificial Sequence
  chemically synthesized
tgcaagtatctacggcacgtac

SEQ ID NO: 66031 - DNA, 22 bp, Artificial Sequence
  chemically synthesized
caagtatctacggcacgtacgc

SEQ ID NO: 66032 - DNA, 22 bp, Artificial Sequence
  chemically synthesized
cggcacgtacgccagctcccaa

SEQ ID NO: 66033 - DNA, 22 bp, Artificial Sequence
  chemically synthesized
ccaagcaggtttgcgggttgca

SEQ ID NO: 66034 - DNA, 22 bp, Artificial Sequence
  chemically synthesized
gcgggttgcacagcgggcgatg

SEQ ID NO: 66035 - DNA, 22 bp, Artificial Sequence
  chemically synthesized
cgggttgcacagcgggcgatgc

SEQ ID NO: 66036 - DNA, 22 bp, Artificial Sequence
  chemically synthesized
cacagcgggcgatgcaatctga

SEQ ID NO: 66037 - DNA, 22 bp, Artificial Sequence
  chemically synthesized
atttaggcttttaaagggattg

SEQ ID NO: 66038 - DNA, 22 bp, Artificial Sequence
  chemically synthesized
aggcttttaaagggattgcaat

SEQ ID NO: 66039 - DNA, 22 bp, Artificial Sequence
  chemically synthesized
ggcttttaaagggattgcaatc

SEQ ID NO: 66040 - DNA, 22 bp, Artificial Sequence
  chemically synthesized
ttaaagggattgcaatcaagtg

SEQ ID NO: 66041 - DNA, 22 bp, Artificial Sequence
  chemically synthesized
taaagggattgcaatcaagtgg

SEQ ID NO: 66042 - DNA, 22 bp, Artificial Sequence
  chemically synthesized
aaagggattgcaatcaagtggg

SEQ ID NO: 66043 - DNA, 22 bp, Artificial Sequence
  chemically synthesized
aagggattgcaatcaagtgggg

SEQ ID NO: 66044 - DNA, 22 bp, Artificial Sequence
  chemically synthesized
caatcaagtggggccccactag

SEQ ID NO: 66045 - DNA, 22 bp, Artificial Sequence
  chemically synthesized
gcctcaaccctgtacctcccct

SEQ ID NO: 66046 - DNA, 22 bp, Artificial Sequence
  chemically synthesized
aaccctgtacctcccctcccct

SEQ ID NO: 66047 - DNA, 22 bp, Artificial Sequence
  chemically synthesized
tacctcccctcccctccacccc

SEQ ID NO: 66048 - DNA, 22 bp, Artificial Sequence
  chemically synthesized
ccctcccctccacccccagcag

SEQ ID NO: 66049 - DNA, 22 bp, Artificial Sequence
  chemically synthesized
ccctccacccccagcagtctcc

SEQ ID NO: 66050 - DNA, 22 bp, Artificial Sequence
  chemically synthesized
cacccccagcagtctccaaagg

SEQ ID NO: 66051 - DNA, 22 bp, Artificial Sequence
  chemically synthesized
caaaggcctccaacaaccccag

SEQ ID NO: 66052 - DNA, 22 bp, Artificial Sequence
  chemically synthesized
caacaaccccagagtgggggcc

SEQ ID NO: 66053 - DNA, 22 bp, Artificial Sequence
  chemically synthesized
caagctgtatacggatcacact

SEQ ID NO: 66054 - DNA, 22 bp, Artificial Sequence
  chemically synthesized
tatacggatcacactggttttc

SEQ ID NO: 66055 - DNA, 22 bp, Artificial Sequence
  chemically synthesized
gttttccaggagcaaaaacaga

SEQ ID NO: 66056 - DNA, 22 bp, Artificial Sequence
  chemically synthesized
tccaggagcaaaaacagaaaca

SEQ ID NO: 66057 - DNA, 22 bp, Artificial Sequence
  chemically synthesized
ccaggagcaaaaacagaaacag

SEQ ID NO: 66058 - DNA, 22 bp, Artificial Sequence
  chemically synthesized
caggagcaaaaacagaaacagg

SEQ ID NO: 66059 - DNA, 22 bp, Artificial Sequence
  chemically synthesized
aggctggtcaaaattgaacctc

SEQ ID NO: 66060 - DNA, 22 bp, Artificial Sequence
  chemically synthesized
gtcaaaattgaacctcctcctg

SEQ ID NO: 66061 - DNA, 22 bp, Artificial Sequence
  chemically synthesized
aacctcctcctgctctgagcag

SEQ ID NO: 66062 - DNA, 22 bp, Artificial Sequence
  chemically synthesized
ctcctgctctgagcagcctggg

SEQ ID NO: 66063 - DNA, 22 bp, Artificial Sequence
  chemically synthesized
ctgctctgagcagcctgggggg

SEQ ID NO: 66064 - DNA, 22 bp, Artificial Sequence
  chemically synthesized
ctctgagcagcctggggggcag

SEQ ID NO: 66065 - DNA, 22 bp, Artificial Sequence
  chemically synthesized
tgagcagcctggggggcagact

SEQ ID NO: 66066 - DNA, 22 bp, Artificial Sequence
  chemically synthesized
agcagcctggggggcagactaa

SEQ ID NO: 66067 - DNA, 22 bp, Artificial Sequence
  chemically synthesized
gggggcagactaagcagagggc

SEQ ID NO: 66068 - DNA, 22 bp, Artificial Sequence
  chemically synthesized
agcagagggctgtgcagaccca

SEQ ID NO: 66069 - DNA, 22 bp, Artificial Sequence
  chemically synthesized
tgcagacccacataaagagcct

SEQ ID NO: 66070 - DNA, 22 bp, Artificial Sequence
  chemically synthesized
ctgtgtgccaggcacttcaccc

SEQ ID NO: 66071 - DNA, 22 bp, Artificial Sequence
  chemically synthesized
tgtgccaggcacttcacccgag

SEQ ID NO: 66072 - DNA, 22 bp, Artificial Sequence
  chemically synthesized
cacccgaggcacttcacaagca

SEQ ID NO: 66073 - DNA, 22 bp, Artificial Sequence
  chemically synthesized
acccgaggcacttcacaagcat

SEQ ID NO: 66074 - DNA, 22 bp, Artificial Sequence
  chemically synthesized
cacaagcatgcttgggaatgaa

SEQ ID NO: 66075 - DNA, 22 bp, Artificial Sequence
  chemically synthesized
acaagcatgcttgggaatgaaa

SEQ ID NO: 66076 - DNA, 22 bp, Artificial Sequence
  chemically synthesized
gggaatgaaacttccaactctt

SEQ ID NO: 66077 - DNA, 22 bp, Artificial Sequence
  chemically synthesized
ggaatgaaacttccaactcttt

SEQ ID NO: 66078 - DNA, 22 bp, Artificial Sequence
  chemically synthesized
ccaactctttgggatgcaggtg

SEQ ID NO: 66079 - DNA, 22 bp, Artificial Sequence
  chemically synthesized
caactctttgggatgcaggtga

SEQ ID NO: 66080 - DNA, 22 bp, Artificial Sequence
  chemically synthesized
tttgggatgcaggtgaaacagt

SEQ ID NO: 66081 - DNA, 22 bp, Artificial Sequence
  chemically synthesized
tgggatgcaggtgaaacagttc

SEQ ID NO: 66082 - DNA, 22 bp, Artificial Sequence
  chemically synthesized
gggatgcaggtgaaacagttcc

SEQ ID NO: 66083 - DNA, 22 bp, Artificial Sequence
  chemically synthesized
ggatgcaggtgaaacagttcct

SEQ ID NO: 66084 - DNA, 22 bp, Artificial Sequence
  chemically synthesized
ctggttcagagaggtgaagcgg

SEQ ID NO: 66085 - DNA, 22 bp, Artificial Sequence
  chemically synthesized
gttcagagaggtgaagcggcct

SEQ ID NO: 66086 - DNA, 22 bp, Artificial Sequence
  chemically synthesized
agagaggtgaagcggcctgcct

SEQ ID NO: 66087 - DNA, 22 bp, Artificial Sequence
  chemically synthesized
cctgaggcagcacagctcttct

SEQ ID NO: 66088 - DNA, 22 bp, Artificial Sequence
  chemically synthesized
aggcagcacagctcttctttac

SEQ ID NO: 66089 - DNA, 22 bp, Artificial Sequence
  chemically synthesized
ttctttacagatgtgcttcccc

SEQ ID NO: 66090 - DNA, 22 bp, Artificial Sequence
  chemically synthesized
ctttacagatgtgcttccccac

SEQ ID NO: 66091 - DNA, 22 bp, Artificial Sequence
  chemically synthesized
tttacagatgtgcttccccacc

SEQ ID NO: 66092 - DNA, 22 bp, Artificial Sequence
  chemically synthesized
tacagatgtgcttccccacctc

SEQ ID NO: 66093 - DNA, 22 bp, Artificial Sequence
  chemically synthesized
acagatgtgcttccccacctct

SEQ ID NO: 66094 - DNA, 22 bp, Artificial Sequence
  chemically synthesized
cagatgtgcttccccacctcta

SEQ ID NO: 66095 - DNA, 22 bp, Artificial Sequence
  chemically synthesized
ccccacctctaccctgtctcac

SEQ ID NO: 66096 - DNA, 22 bp, Artificial Sequence
  chemically synthesized
cccacctctaccctgtctcacg

SEQ ID NO: 66097 - DNA, 22 bp, Artificial Sequence
  chemically synthesized
taccctgtctcacggcccccca

SEQ ID NO: 66098 - DNA, 22 bp, Artificial Sequence
  chemically synthesized
ccctgtctcacggccccccatg

SEQ ID NO: 66099 - DNA, 22 bp, Artificial Sequence
  chemically synthesized
tctcacggccccccatgccagc

SEQ ID NO: 66100 - DNA, 22 bp, Artificial Sequence
  chemically synthesized
acggccccccatgccagcctga

SEQ ID NO: 66101 - DNA, 22 bp, Artificial Sequence
  chemically synthesized
acggttgtgtctgcctcagtca

SEQ ID NO: 66102 - DNA, 22 bp, Artificial Sequence
  chemically synthesized
tgtctgcctcagtcatgctcca

SEQ ID NO: 66103 - DNA, 22 bp, Artificial Sequence
  chemically synthesized
cctcagtcatgctccatttttc

SEQ ID NO: 66104 - DNA, 22 bp, Artificial Sequence
  chemically synthesized
agtcatgctccatttttccatc

SEQ ID NO: 66105 - DNA, 22 bp, Artificial Sequence
  chemically synthesized
catttttccatcgggaccatca

SEQ ID NO: 66106 - DNA, 22 bp, Artificial Sequence
  chemically synthesized
ttccatcgggaccatcaagagg

SEQ ID NO: 66107 - DNA, 22 bp, Artificial Sequence
  chemically synthesized
tccatcgggaccatcaagaggg

SEQ ID NO: 66108 - DNA, 22 bp, Artificial Sequence
  chemically synthesized
ccatcgggaccatcaagagggt

SEQ ID NO: 66109 - DNA, 22 bp, Artificial Sequence
  chemically synthesized
catcgggaccatcaagagggtg

SEQ ID NO: 66110 - DNA, 22 bp, Artificial Sequence
  chemically synthesized
gtgtctaaggctgactgggtaa

SEQ ID NO: 66111 - DNA, 22 bp, Artificial Sequence
  chemically synthesized
tgtctaaggctgactgggtaac

SEQ ID NO: 66112 - DNA, 22 bp, Artificial Sequence
  chemically synthesized
aggctgactgggtaactttgga

SEQ ID NO: 66113 - DNA, 22 bp, Artificial Sequence
  chemically synthesized
actgggtaactttggatgagcg

SEQ ID NO: 66114 - DNA, 22 bp, Artificial Sequence
  chemically synthesized
ggtaactttggatgagcggtct

SEQ ID NO: 66115 - DNA, 22 bp, Artificial Sequence
  chemically synthesized
tggatgagcggtctctccgctc

SEQ ID NO: 66116 - DNA, 22 bp, Artificial Sequence
  chemically synthesized
ggatgagcggtctctccgctct

SEQ ID NO: 66117 - DNA, 22 bp, Artificial Sequence
  chemically synthesized
gatgagcggtctctccgctctg

SEQ ID NO: 66118 - DNA, 22 bp, Artificial Sequence
  chemically synthesized
tccgctctgagcctgtttcctc

SEQ ID NO: 66119 - DNA, 22 bp, Artificial Sequence
  chemically synthesized
cgctctgagcctgtttcctcat

SEQ ID NO: 66120 - DNA, 22 bp, Artificial Sequence
  chemically synthesized
tgagcctgtttcctcatctgtc

SEQ ID NO: 66121 - DNA, 22 bp, Artificial Sequence
  chemically synthesized
agcctgtttcctcatctgtcaa

SEQ ID NO: 66122 - DNA, 22 bp, Artificial Sequence
  chemically synthesized
tttcctcatctgtcaaatgggc

SEQ ID NO: 66123 - DNA, 22 bp, Artificial Sequence
  chemically synthesized
cctcatctgtcaaatgggctct

SEQ ID NO: 66124 - DNA, 22 bp, Artificial Sequence
  chemically synthesized
ctcatctgtcaaatgggctcta

SEQ ID NO: 66125 - DNA, 22 bp, Artificial Sequence
  chemically synthesized
atctgtcaaatgggctctaacc

SEQ ID NO: 66126 - DNA, 22 bp, Artificial Sequence
  chemically synthesized
tcaaatgggctctaacccactc

SEQ ID NO: 66127 - DNA, 22 bp, Artificial Sequence
  chemically synthesized
taacccactctgatctcccagg

SEQ ID NO: 66128 - DNA, 22 bp, Artificial Sequence
  chemically synthesized
acccactctgatctcccagggc

SEQ ID NO: 66129 - DNA, 22 bp, Artificial Sequence
  chemically synthesized
tgatctcccagggcggcagtaa

SEQ ID NO: 66130 - DNA, 22 bp, Artificial Sequence
  chemically synthesized
atctcccagggcggcagtaagt

SEQ ID NO: 66131 - DNA, 22 bp, Artificial Sequence
  chemically synthesized
ccagggcggcagtaagtcttca

SEQ ID NO: 66132 - DNA, 22 bp, Artificial Sequence
  chemically synthesized
cagcatcaggcattttggggtg

SEQ ID NO: 66133 - DNA, 22 bp, Artificial Sequence
  chemically synthesized
agcatcaggcattttggggtga

SEQ ID NO: 66134 - DNA, 22 bp, Artificial Sequence
  chemically synthesized
tggggtgactcagtaaatggta

SEQ ID NO: 66135 - DNA, 22 bp, Artificial Sequence
  chemically synthesized
ggggtgactcagtaaatggtag

SEQ ID NO: 66136 - DNA, 22 bp, Artificial Sequence
  chemically synthesized
gggtgactcagtaaatggtaga

SEQ ID NO: 66137 - DNA, 22 bp, Artificial Sequence
  chemically synthesized
agtaaatggtagatcttgctac

SEQ ID NO: 66138 - DNA, 22 bp, Artificial Sequence
  chemically synthesized
gctaccagtggaacagccacta

SEQ ID NO: 66139 - DNA, 22 bp, Artificial Sequence
  chemically synthesized
ctaccagtggaacagccactaa

SEQ ID NO: 66140 - DNA, 22 bp, Artificial Sequence
  chemically synthesized
ccagtggaacagccactaagga

SEQ ID NO: 66141 - DNA, 22 bp, Artificial Sequence
  chemically synthesized
aggattctgcagtgagagcaga

SEQ ID NO: 66142 - DNA, 22 bp, Artificial Sequence
  chemically synthesized
tgcagtgagagcagagggccag

SEQ ID NO: 66143 - DNA, 22 bp, Artificial Sequence
  chemically synthesized
cagtgagagcagagggccagct

SEQ ID NO: 66144 - DNA, 22 bp, Artificial Sequence
  chemically synthesized
agtggtactctcccagagactg

SEQ ID NO: 66145 - DNA, 22 bp, Artificial Sequence
  chemically synthesized
tcccagagactgtctgactcac

SEQ ID NO: 66146 - DNA, 22 bp, Artificial Sequence
  chemically synthesized
ccagagactgtctgactcacgc

SEQ ID NO: 66147 - DNA, 22 bp, Artificial Sequence
  chemically synthesized
tctgactcacgccaccccctcc

SEQ ID NO: 66148 - DNA, 22 bp, Artificial Sequence
  chemically synthesized
actcacgccaccccctccacct

SEQ ID NO: 66149 - DNA, 22 bp, Artificial Sequence
  chemically synthesized
acgccaccccctccaccttgga

SEQ ID NO: 66150 - DNA, 22 bp, Artificial Sequence
  chemically synthesized
caccttggacacaggacgctgt

SEQ ID NO: 66151 - DNA, 22 bp, Artificial Sequence
  chemically synthesized
ggacacaggacgctgtggtttc

SEQ ID NO: 66152 - DNA, 22 bp, Artificial Sequence
  chemically synthesized
gacacaggacgctgtggtttct

SEQ ID NO: 66153 - DNA, 22 bp, Artificial Sequence
  chemically synthesized
tggtttctgagccaggtacaat

SEQ ID NO: 66154 - DNA, 22 bp, Artificial Sequence
  chemically synthesized
ctgagccaggtacaatgactcc

SEQ ID NO: 66155 - DNA, 22 bp, Artificial Sequence
  chemically synthesized
tgagccaggtacaatgactcct

SEQ ID NO: 66156 - DNA, 22 bp, Artificial Sequence
  chemically synthesized
agccaggtacaatgactccttt

SEQ ID NO: 66157 - DNA, 22 bp, Artificial Sequence
  chemically synthesized
ctttcggtaagtgcagtggaag

SEQ ID NO: 66158 - DNA, 22 bp, Artificial Sequence
  chemically synthesized
tcggtaagtgcagtggaagctg

SEQ ID NO: 66159 - DNA, 22 bp, Artificial Sequence
  chemically synthesized
cggtaagtgcagtggaagctgt

SEQ ID NO: 66160 - DNA, 22 bp, Artificial Sequence
  chemically synthesized
ggtaagtgcagtggaagctgta

SEQ ID NO: 66161 - DNA, 22 bp, Artificial Sequence
  chemically synthesized
tacactgcccaggcaaagcgtc

SEQ ID NO: 66162 - DNA, 22 bp, Artificial Sequence
  chemically synthesized
cccaggcaaagcgtccgggcag

SEQ ID NO: 66163 - DNA, 22 bp, Artificial Sequence
  chemically synthesized
agatcccagccagtggacttag

SEQ ID NO: 66164 - DNA, 22 bp, Artificial Sequence
  chemically synthesized
agcccctgtttgctcctccgat

SEQ ID NO: 66165 - DNA, 22 bp, Artificial Sequence
  chemically synthesized
gcccctgtttgctcctccgata

SEQ ID NO: 66166 - DNA, 22 bp, Artificial Sequence
  chemically synthesized
tttgctcctccgataactgggg

SEQ ID NO: 66167 - DNA, 22 bp, Artificial Sequence
  chemically synthesized
gctcctccgataactggggtga

SEQ ID NO: 66168 - DNA, 22 bp, Artificial Sequence
  chemically synthesized
ctcctccgataactggggtgac

SEQ ID NO: 66169 - DNA, 22 bp, Artificial Sequence
  chemically synthesized
ctccgataactggggtgacctt

SEQ ID NO: 66170 - DNA, 22 bp, Artificial Sequence
  chemically synthesized
cgataactggggtgaccttggt

SEQ ID NO: 66171 - DNA, 22 bp, Artificial Sequence
  chemically synthesized
gggtgaccttggttaatattca

SEQ ID NO: 66172 - DNA, 22 bp, Artificial Sequence
  chemically synthesized
ggttaatattcaccagcagcct

SEQ ID NO: 66173 - DNA, 22 bp, Artificial Sequence
  chemically synthesized
gttaatattcaccagcagcctc

SEQ ID NO: 66174 - DNA, 22 bp, Artificial Sequence
  chemically synthesized
atattcaccagcagcctccccc

SEQ ID NO: 66175 - DNA, 22 bp, Artificial Sequence
  chemically synthesized
accagcagcctcccccgttgcc

SEQ ID NO: 66176 - DNA, 22 bp, Artificial Sequence
  chemically synthesized
ccccgttgcccctctggatcca

SEQ ID NO: 66177 - DNA, 22 bp, Artificial Sequence
  chemically synthesized
cccctctggatccactgcttaa

SEQ ID NO: 66178 - DNA, 22 bp, Artificial Sequence
  chemically synthesized
tggatccactgcttaaatacgg

SEQ ID NO: 66179 - DNA, 22 bp, Artificial Sequence
  chemically synthesized
gatccactgcttaaatacggac

SEQ ID NO: 66180 - DNA, 22 bp, Artificial Sequence
  chemically synthesized
cttaaatacggacgaggacagg

SEQ ID NO: 66181 - DNA, 22 bp, Artificial Sequence
  chemically synthesized
aaatacggacgaggacagggcc

SEQ ID NO: 66182 - DNA, 22 bp, Artificial Sequence
  chemically synthesized
aatacggacgaggacagggccc

SEQ ID NO: 66183 - DNA, 22 bp, Artificial Sequence
  chemically synthesized
tctcctcagcttcaggcaccac

SEQ ID NO: 66184 - DNA, 22 bp, Artificial Sequence
  chemically synthesized
ctcagcttcaggcaccaccact

SEQ ID NO: 66185 - DNA, 22 bp, Artificial Sequence
  chemically synthesized
agcttcaggcaccaccactgac

SEQ ID NO: 66186 - DNA, 22 bp, Artificial Sequence
  chemically synthesized
caggcaccaccactgacctggg

SEQ ID NO: 66187 - DNA, 22 bp, Artificial Sequence
  chemically synthesized
aggcaccaccactgacctggga

SEQ ID NO: 66188 - DNA, 22 bp, Artificial Sequence
  chemically synthesized
acctgggacagtgaatcgtaag

SEQ ID NO: 66189 - DNA, 22 bp, Artificial Sequence
  chemically synthesized
ggacagtgaatcgtaagtatgc

SEQ ID NO: 66190 - DNA, 22 bp, Artificial Sequence
  chemically synthesized
tcactgcgagaggttctggaga

SEQ ID NO: 66191 - DNA, 22 bp, Artificial Sequence
  chemically synthesized
cactgcgagaggttctggagag

SEQ ID NO: 66192 - DNA, 22 bp, Artificial Sequence
  chemically synthesized
actgcgagaggttctggagagg

SEQ ID NO: 66193 - DNA, 22 bp, Artificial Sequence
  chemically synthesized
cgagaggttctggagaggcttc

SEQ ID NO: 66194 - DNA, 22 bp, Artificial Sequence
  chemically synthesized
tggagaggcttctgagctcccc

SEQ ID NO: 66195 - DNA, 22 bp, Artificial Sequence
  chemically synthesized
gagaggcttctgagctccccat

SEQ ID NO: 66196 - DNA, 22 bp, Artificial Sequence
  chemically synthesized
ctgagctccccatggcccaggc

SEQ ID NO: 66197 - DNA, 22 bp, Artificial Sequence
  chemically synthesized
tgagctccccatggcccaggca

SEQ ID NO: 66198 - DNA, 22 bp, Artificial Sequence
  chemically synthesized
agctccccatggcccaggcagg

SEQ ID NO: 66199 - DNA, 22 bp, Artificial Sequence
  chemically synthesized
cccatggcccaggcaggcagca

SEQ ID NO: 66200 - DNA, 22 bp, Artificial Sequence
  chemically synthesized
gggcaggaggggggttgtggag

SEQ ID NO: 66201 - DNA, 22 bp, Artificial Sequence
  chemically synthesized
tggagtgggtatccgcctgctg

SEQ ID NO: 66202 - DNA, 22 bp, Artificial Sequence
  chemically synthesized
ctgaggtgcagggcagatggag

SEQ ID NO: 66203 - DNA, 22 bp, Artificial Sequence
  chemically synthesized
aggtgcagggcagatggagagg

SEQ ID NO: 66204 - DNA, 22 bp, Artificial Sequence
  chemically synthesized
cagctgagctcctattttcata

SEQ ID NO: 66205 - DNA, 22 bp, Artificial Sequence
  chemically synthesized
agctcctattttcataataaca

SEQ ID NO: 66206 - DNA, 22 bp, Artificial Sequence
  chemically synthesized
ctattttcataataacagcagc

SEQ ID NO: 66207 - DNA, 22 bp, Artificial Sequence
  chemically synthesized
ttttcataataacagcagccat

SEQ ID NO: 66208 - DNA, 22 bp, Artificial Sequence
  chemically synthesized
tcataataacagcagccatgag

SEQ ID NO: 66209 - DNA, 22 bp, Artificial Sequence
  chemically synthesized
cataataacagcagccatgagg

SEQ ID NO: 66210 - DNA, 22 bp, Artificial Sequence
  chemically synthesized
ataataacagcagccatgaggg

SEQ ID NO: 66211 - DNA, 22 bp, Artificial Sequence
  chemically synthesized
tgtcctgtttcccagtcctgcc

SEQ ID NO: 66212 - DNA, 22 bp, Artificial Sequence
  chemically synthesized
tttcccagtcctgcccggtccc

SEQ ID NO: 66213 - DNA, 22 bp, Artificial Sequence
  chemically synthesized
cccagtcctgcccggtcccccc

SEQ ID NO: 66214 - DNA, 22 bp, Artificial Sequence
  chemically synthesized
ccagtcctgcccggtcccccct

SEQ ID NO: 66215 - DNA, 22 bp, Artificial Sequence
  chemically synthesized
cccggtcccccctcggtacctc

SEQ ID NO: 66216 - DNA, 22 bp, Artificial Sequence
  chemically synthesized
ggtacctcctggtggatacact

SEQ ID NO: 66217 - DNA, 22 bp, Artificial Sequence
  chemically synthesized
ctggtggatacactggttcctg

SEQ ID NO: 66218 - DNA, 22 bp, Artificial Sequence
  chemically synthesized
gtggatacactggttcctgtaa

SEQ ID NO: 66219 - DNA, 22 bp, Artificial Sequence
  chemically synthesized
gttcctgtaagcagaagtggat

SEQ ID NO: 66220 - DNA, 22 bp, Artificial Sequence
  chemically synthesized
ctgtaagcagaagtggatgagg

SEQ ID NO: 66221 - DNA, 22 bp, Artificial Sequence
  chemically synthesized
taagcagaagtggatgagggtg

SEQ ID NO: 66222 - DNA, 22 bp, Artificial Sequence
  chemically synthesized
ggtctgcagtcctggcacccca

SEQ ID NO: 66223 - DNA, 22 bp, Artificial Sequence
  chemically synthesized
cagtcctggcaccccaggatgg

SEQ ID NO: 66224 - DNA, 22 bp, Artificial Sequence
  chemically synthesized
gcaccccaggatgggggacacc

SEQ ID NO: 66225 - DNA, 22 bp, Artificial Sequence
  chemically synthesized
ctttctgtttgcacagctcctc

SEQ ID NO: 66226 - DNA, 22 bp, Artificial Sequence
  chemically synthesized
tttctgtttgcacagctcctct

SEQ ID NO: 66227 - DNA, 22 bp, Artificial Sequence
  chemically synthesized
tctgtttgcacagctcctctgt

SEQ ID NO: 66228 - DNA, 22 bp, Artificial Sequence
  chemically synthesized
ctgtttgcacagctcctctgtc

SEQ ID NO: 66229 - DNA, 22 bp, Artificial Sequence
  chemically synthesized
tgtttgcacagctcctctgtct

SEQ ID NO: 66230 - DNA, 22 bp, Artificial Sequence
  chemically synthesized
tttgcacagctcctctgtctgt

SEQ ID NO: 66231 - DNA, 22 bp, Artificial Sequence
  chemically synthesized
gcacagctcctctgtctgtcgg

SEQ ID NO: 66232 - DNA, 22 bp, Artificial Sequence
  chemically synthesized
cacagctcctctgtctgtcggg

SEQ ID NO: 66233 - DNA, 22 bp, Artificial Sequence
  chemically synthesized
ctctgtctgtcgggggctcctg

SEQ ID NO: 66234 - DNA, 22 bp, Artificial Sequence
  chemically synthesized
tgtctgtcgggggctcctgtct

SEQ ID NO: 66235 - DNA, 22 bp, Artificial Sequence
  chemically synthesized
tctgtcgggggctcctgtctgt

SEQ ID NO: 66236 - DNA, 22 bp, Artificial Sequence
  chemically synthesized
tcgggggctcctgtctgttgtc

SEQ ID NO: 66237 - DNA, 22 bp, Artificial Sequence
  chemically synthesized
ctgtctgttgtctcctataagc

SEQ ID NO: 66238 - DNA, 22 bp, Artificial Sequence
  chemically synthesized
tctgttgtctcctataagcctc

SEQ ID NO: 66239 - DNA, 22 bp, Artificial Sequence
  chemically synthesized
ttgtctcctataagcctcacca

SEQ ID NO: 66240 - DNA, 22 bp, Artificial Sequence
  chemically synthesized
tctcctataagcctcaccacct

SEQ ID NO: 66241 - DNA, 22 bp, Artificial Sequence
  chemically synthesized
ctataagcctcaccacctctcc

SEQ ID NO: 66242 - DNA, 22 bp, Artificial Sequence
  chemically synthesized
taagcctcaccacctctcctac

SEQ ID NO: 66243 - DNA, 22 bp, Artificial Sequence
  chemically synthesized
accacctctcctactgcttggg

SEQ ID NO: 66244 - DNA, 22 bp, Artificial Sequence
  chemically synthesized
tcctactgcttgggcatgcatc

SEQ ID NO: 66245 - DNA, 22 bp, Artificial Sequence
  chemically synthesized
ctactgcttgggcatgcatctt

SEQ ID NO: 66246 - DNA, 22 bp, Artificial Sequence
  chemically synthesized
ctgcttgggcatgcatctttct

SEQ ID NO: 66247 - DNA, 22 bp, Artificial Sequence
  chemically synthesized
cttgggcatgcatctttctccc

SEQ ID NO: 66248 - DNA, 22 bp, Artificial Sequence
  chemically synthesized
gggcatgcatctttctcccctt

SEQ ID NO: 66249 - DNA, 22 bp, Artificial Sequence
  chemically synthesized
ggcatgcatctttctccccttc

SEQ ID NO: 66250 - DNA, 22 bp, Artificial Sequence
  chemically synthesized
tctccccttctatagatgagga

SEQ ID NO: 66251 - DNA, 22 bp, Artificial Sequence
  chemically synthesized
ctccccttctatagatgaggag

SEQ ID NO: 66252 - DNA, 22 bp, Artificial Sequence
  chemically synthesized
tccccttctatagatgaggagg

SEQ ID NO: 66253 - DNA, 22 bp, Artificial Sequence
  chemically synthesized
cccttctatagatgaggaggtt

SEQ ID NO: 66254 - DNA, 22 bp, Artificial Sequence
  chemically synthesized
ctatagatgaggaggttaaggt

SEQ ID NO: 66255 - DNA, 22 bp, Artificial Sequence
  chemically synthesized
tatagatgaggaggttaaggtc

SEQ ID NO: 66256 - DNA, 22 bp, Artificial Sequence
  chemically synthesized
tagatgaggaggttaaggtcca

SEQ ID NO: 66257 - DNA, 22 bp, Artificial Sequence
  chemically synthesized
aggtccagagaggggtggggag

SEQ ID NO: 66258 - DNA, 22 bp, Artificial Sequence
  chemically synthesized
acattctccatcccctccagat

SEQ ID NO: 66259 - DNA, 22 bp, Artificial Sequence
  chemically synthesized
tccatcccctccagatatgacc

SEQ ID NO: 66260 - DNA, 22 bp, Artificial Sequence
  chemically synthesized
catcccctccagatatgaccag

SEQ ID NO: 66261 - DNA, 22 bp, Artificial Sequence
  chemically synthesized
cagatatgaccaggaacagacc

SEQ ID NO: 66262 - DNA, 22 bp, Artificial Sequence
  chemically synthesized
tgccaggcctcagccttacatc

SEQ ID NO: 66263 - DNA, 22 bp, Artificial Sequence
  chemically synthesized
agccttacatcaaaatgggcct

SEQ ID NO: 66264 - DNA, 22 bp, Artificial Sequence
  chemically synthesized
acatcaaaatgggcctccccat

SEQ ID NO: 66265 - DNA, 22 bp, Artificial Sequence
  chemically synthesized
catcaaaatgggcctccccatg

SEQ ID NO: 66266 - DNA, 22 bp, Artificial Sequence
  chemically synthesized
cccatgcaccgtggacctctgg

SEQ ID NO: 66267 - DNA, 22 bp, Artificial Sequence
  chemically synthesized
tgggccctcctgtcccagtgga

SEQ ID NO: 66268 - DNA, 22 bp, Artificial Sequence
  chemically synthesized
ggccctcctgtcccagtggagg

SEQ ID NO: 66269 - DNA, 22 bp, Artificial Sequence
  chemically synthesized
ctgtcccagtggaggacaggaa

SEQ ID NO: 66270 - DNA, 22 bp, Artificial Sequence
  chemically synthesized
tcccagtggaggacaggaagct

SEQ ID NO: 66271 - DNA, 22 bp, Artificial Sequence
  chemically synthesized
tgaggggcactgtcacccaggg

SEQ ID NO: 66272 - DNA, 22 bp, Artificial Sequence
  chemically synthesized
tcacccagggctcaagctggca

SEQ ID NO: 66273 - DNA, 22 bp, Artificial Sequence
  chemically synthesized
aagctggcattcctgaataatc

SEQ ID NO: 66274 - DNA, 22 bp, Artificial Sequence
  chemically synthesized
gcattcctgaataatcgctctg

SEQ ID NO: 66275 - DNA, 22 bp, Artificial Sequence
  chemically synthesized
ctgaataatcgctctgcaccag

SEQ ID NO: 66276 - DNA, 22 bp, Artificial Sequence
  chemically synthesized
aataatcgctctgcaccaggcc

SEQ ID NO: 66277 - DNA, 22 bp, Artificial Sequence
  chemically synthesized
tgcaccaggccacggctaagct

SEQ ID NO: 66278 - DNA, 22 bp, Artificial Sequence
  chemically synthesized
caccaggccacggctaagctca

SEQ ID NO: 66279 - DNA, 22 bp, Artificial Sequence
  chemically synthesized
agctcagtgcgtgattaagcct

SEQ ID NO: 66280 - DNA, 22 bp, Artificial Sequence
  chemically synthesized
agtgcgtgattaagcctcataa

SEQ ID NO: 66281 - DNA, 22 bp, Artificial Sequence
  chemically synthesized
agcctcataaccctccaaggca

SEQ ID NO: 66282 - DNA, 22 bp, Artificial Sequence
  chemically synthesized
ataaccctccaaggcagttact

SEQ ID NO: 66283 - DNA, 22 bp, Artificial Sequence
  chemically synthesized
caaggcagttactagtgtgatt

SEQ ID NO: 66284 - DNA, 22 bp, Artificial Sequence
  chemically synthesized
ctagtgtgattcccattttaca

SEQ ID NO: 66285 - DNA, 22 bp, Artificial Sequence
  chemically synthesized
gtgtgattcccattttacagat

SEQ ID NO: 66286 - DNA, 22 bp, Artificial Sequence
  chemically synthesized
ccattttacagatgaggaagat

SEQ ID NO: 66287 - DNA, 22 bp, Artificial Sequence
  chemically synthesized
tacagatgaggaagatggggac

SEQ ID NO: 66288 - DNA, 22 bp, Artificial Sequence
  chemically synthesized
acagatgaggaagatggggaca

SEQ ID NO: 66289 - DNA, 22 bp, Artificial Sequence
  chemically synthesized
cagatgaggaagatggggacag

SEQ ID NO: 66290 - DNA, 22 bp, Artificial Sequence
  chemically synthesized
gccccaaatcacacaccatcca

SEQ ID NO: 66291 - DNA, 22 bp, Artificial Sequence
  chemically synthesized
gggctcaggcacctggctccag

SEQ ID NO: 66292 - DNA, 22 bp, Artificial Sequence
  chemically synthesized
aggcacctggctccagtcccca

SEQ ID NO: 66293 - DNA, 22 bp, Artificial Sequence
  chemically synthesized
gctccagtccccaaactcttga

SEQ ID NO: 66294 - DNA, 22 bp, Artificial Sequence
  chemically synthesized
cagtccccaaactcttgaacct

SEQ ID NO: 66295 - DNA, 22 bp, Artificial Sequence
  chemically synthesized
ttgaacctggccctagtgtcac

SEQ ID NO: 66296 - DNA, 22 bp, Artificial Sequence
  chemically synthesized
gaacctggccctagtgtcactg

SEQ ID NO: 66297 - DNA, 22 bp, Artificial Sequence
  chemically synthesized
aacctggccctagtgtcactgt

SEQ ID NO: 66298 - DNA, 22 bp, Artificial Sequence
  chemically synthesized
gccctagtgtcactgtttctct

SEQ ID NO: 66299 - DNA, 22 bp, Artificial Sequence
  chemically synthesized
gtgtcactgtttctcttgggtc

SEQ ID NO: 66300 - DNA, 22 bp, Artificial Sequence
  chemically synthesized
tttctcttgggtctcaggcgct

SEQ ID NO: 66301 - DNA, 22 bp, Artificial Sequence
  chemically synthesized
ctcttgggtctcaggcgctgga

SEQ ID NO: 66302 - DNA, 22 bp, Artificial Sequence
  chemically synthesized
tcttgggtctcaggcgctggat

SEQ ID NO: 66303 - DNA, 22 bp, Artificial Sequence
  chemically synthesized
ttgggtctcaggcgctggatgg

SEQ ID NO: 66304 - DNA, 22 bp, Artificial Sequence
  chemically synthesized
gggtctcaggcgctggatgggg

SEQ ID NO: 66305 - DNA, 22 bp, Artificial Sequence
  chemically synthesized
ggtctcaggcgctggatgggga

SEQ ID NO: 66306 - DNA, 22 bp, Artificial Sequence
  chemically synthesized
aggcgctggatggggaacagga

SEQ ID NO: 66307 - DNA, 22 bp, Artificial Sequence
  chemically synthesized
gatggggaacaggaaacctggg

SEQ ID NO: 66308 - DNA, 22 bp, Artificial Sequence
  chemically synthesized
ggctggacttgaggcctctctg

SEQ ID NO: 66309 - DNA, 22 bp, Artificial Sequence
  chemically synthesized
gacttgaggcctctctgatgct

SEQ ID NO: 66310 - DNA, 22 bp, Artificial Sequence
  chemically synthesized
gaggcctctctgatgctcggtg

SEQ ID NO: 66311 - DNA, 22 bp, Artificial Sequence
  chemically synthesized
aggcctctctgatgctcggtga

SEQ ID NO: 66312 - DNA, 22 bp, Artificial Sequence
  chemically synthesized
tctgatgctcggtgacttcaga

SEQ ID NO: 66313 - DNA, 22 bp, Artificial Sequence
  chemically synthesized
tgatgctcggtgacttcagaca

SEQ ID NO: 66314 - DNA, 22 bp, Artificial Sequence
  chemically synthesized
atgctcggtgacttcagacagt

SEQ ID NO: 66315 - DNA, 22 bp, Artificial Sequence
  chemically synthesized
ggtgacttcagacagttgctca

SEQ ID NO: 66316 - DNA, 22 bp, Artificial Sequence
  chemically synthesized
cagacagttgctcaacctctct

SEQ ID NO: 66317 - DNA, 22 bp, Artificial Sequence
  chemically synthesized
agacagttgctcaacctctctg

SEQ ID NO: 66318 - DNA, 22 bp, Artificial Sequence
  chemically synthesized
ctcaacctctctgttctcttgg

SEQ ID NO: 66319 - DNA, 22 bp, Artificial Sequence
  chemically synthesized
aacctctctgttctcttgggca

SEQ ID NO: 66320 - DNA, 22 bp, Artificial Sequence
  chemically synthesized
tctgttctcttgggcaaaacat

SEQ ID NO: 66321 - DNA, 22 bp, Artificial Sequence
  chemically synthesized
tgttctcttgggcaaaacatga

SEQ ID NO: 66322 - DNA, 22 bp, Artificial Sequence
  chemically synthesized
ttctcttgggcaaaacatgata

SEQ ID NO: 66323 - DNA, 22 bp, Artificial Sequence
  chemically synthesized
tcttgggcaaaacatgataacc

SEQ ID NO: 66324 - DNA, 22 bp, Artificial Sequence
  chemically synthesized
ttgggcaaaacatgataacctt

SEQ ID NO: 66325 - DNA, 22 bp, Artificial Sequence
  chemically synthesized
gggcaaaacatgataacctttg

SEQ ID NO: 66326 - DNA, 22 bp, Artificial Sequence
  chemically synthesized
ggcaaaacatgataacctttga

SEQ ID NO: 66327 - DNA, 22 bp, Artificial Sequence
  chemically synthesized
tgacttctgtcccctcccctca

SEQ ID NO: 66328 - DNA, 22 bp, Artificial Sequence
  chemically synthesized
gacttctgtcccctcccctcac

SEQ ID NO: 66329 - DNA, 22 bp, Artificial Sequence
  chemically synthesized
acttctgtcccctcccctcacc

SEQ ID NO: 66330 - DNA, 22 bp, Artificial Sequence
  chemically synthesized
ctgtcccctcccctcaccccac

SEQ ID NO: 66331 - DNA, 22 bp, Artificial Sequence
  chemically synthesized
tgtcccctcccctcaccccacc

SEQ ID NO: 66332 - DNA, 22 bp, Artificial Sequence
  chemically synthesized
tcccctcccctcaccccacccg

SEQ ID NO: 66333 - DNA, 22 bp, Artificial Sequence
  chemically synthesized
ccctcaccccacccgaccttga

SEQ ID NO: 66334 - DNA, 22 bp, Artificial Sequence
  chemically synthesized
accccacccgaccttgatctct

SEQ ID NO: 66335 - DNA, 22 bp, Artificial Sequence
  chemically synthesized
gatctctgaagtgttggaagga

SEQ ID NO: 66336 - DNA, 22 bp, Artificial Sequence
  chemically synthesized
atctctgaagtgttggaaggat

SEQ ID NO: 66337 - DNA, 22 bp, Artificial Sequence
  chemically synthesized
tgaagtgttggaaggatttaat

SEQ ID NO: 66338 - DNA, 22 bp, Artificial Sequence
  chemically synthesized
aagtgttggaaggatttaattt

SEQ ID NO: 66339 - DNA, 22 bp, Artificial Sequence
  chemically synthesized
gaaggatttaatttttcctgca

SEQ ID NO: 66340 - DNA, 22 bp, Artificial Sequence
  chemically synthesized
aatttttcctgcactgagtttt

SEQ ID NO: 66341 - DNA, 22 bp, Artificial Sequence
  chemically synthesized
atttttcctgcactgagttttg

SEQ ID NO: 66342 - DNA, 22 bp, Artificial Sequence
  chemically synthesized
ttcctgcactgagttttggaga

SEQ ID NO: 66343 - DNA, 22 bp, Artificial Sequence
  chemically synthesized
tcctgcactgagttttggagac

SEQ ID NO: 66344 - DNA, 22 bp, Artificial Sequence
  chemically synthesized
cctgcactgagttttggagaca

SEQ ID NO: 66345 - DNA, 22 bp, Artificial Sequence
  chemically synthesized
ctgcactgagttttggagacag

SEQ ID NO: 66346 - DNA, 22 bp, Artificial Sequence
  chemically synthesized
cactgagttttggagacaggtc

SEQ ID NO: 66347 - DNA, 22 bp, Artificial Sequence
  chemically synthesized
agttttggagacaggtcaaaaa

SEQ ID NO: 66348 - DNA, 22 bp, Artificial Sequence
  chemically synthesized
tggagacaggtcaaaaagatga

SEQ ID NO: 66349 - DNA, 22 bp, Artificial Sequence
  chemically synthesized
ggagacaggtcaaaaagatgac

SEQ ID NO: 66350 - DNA, 22 bp, Artificial Sequence
  chemically synthesized
gagacaggtcaaaaagatgacc

SEQ ID NO: 66351 - DNA, 22 bp, Artificial Sequence
  chemically synthesized
cctatagaacgcctctaaaaga

SEQ ID NO: 66352 - DNA, 22 bp, Artificial Sequence
  chemically synthesized
ctatagaacgcctctaaaagac

SEQ ID NO: 66353 - DNA, 22 bp, Artificial Sequence
  chemically synthesized
tagaacgcctctaaaagacctg

SEQ ID NO: 66354 - DNA, 22 bp, Artificial Sequence
  chemically synthesized
taaaagacctgcagcaatagca

SEQ ID NO: 66355 - DNA, 22 bp, Artificial Sequence
  chemically synthesized
aaagacctgcagcaatagcagc

SEQ ID NO: 66356 - DNA, 22 bp, Artificial Sequence
  chemically synthesized
cagcaatagcagcaagaactgg

SEQ ID NO: 66357 - DNA, 22 bp, Artificial Sequence
  chemically synthesized
gtattctcgagaacttgctgcg

SEQ ID NO: 66358 - DNA, 22 bp, Artificial Sequence
  chemically synthesized
tcgagaacttgctgcgcagcag

SEQ ID NO: 66359 - DNA, 22 bp, Artificial Sequence
  chemically synthesized
gagaacttgctgcgcagcaggc

SEQ ID NO: 66360 - DNA, 22 bp, Artificial Sequence
  chemically synthesized
gctgcgcagcaggcacttcttg

SEQ ID NO: 66361 - DNA, 22 bp, Artificial Sequence
  chemically synthesized
ctgcgcagcaggcacttcttgg

SEQ ID NO: 66362 - DNA, 22 bp, Artificial Sequence
  chemically synthesized
cgcagcaggcacttcttggcat

SEQ ID NO: 66363 - DNA, 22 bp, Artificial Sequence
  chemically synthesized
cttggcattttatgtgtattta

SEQ ID NO: 66364 - DNA, 22 bp, Artificial Sequence
  chemically synthesized
ttggcattttatgtgtatttaa

SEQ ID NO: 66365 - DNA, 22 bp, Artificial Sequence
  chemically synthesized
ggcattttatgtgtatttaatt

SEQ ID NO: 66366 - DNA, 22 bp, Artificial Sequence
  chemically synthesized
gcattttatgtgtatttaattt

SEQ ID NO: 66367 - DNA, 22 bp, Artificial Sequence
  chemically synthesized
tatgtgtatttaatttcacaat

SEQ ID NO: 66368 - DNA, 22 bp, Artificial Sequence
  chemically synthesized
atgtgtatttaatttcacaata

SEQ ID NO: 66369 - DNA, 22 bp, Artificial Sequence
  chemically synthesized
tgtgtatttaatttcacaatag

SEQ ID NO: 66370 - DNA, 22 bp, Artificial Sequence
  chemically synthesized
aatttcacaatagctctatgac

SEQ ID NO: 66371 - DNA, 22 bp, Artificial Sequence
  chemically synthesized
atttcacaatagctctatgaca

SEQ ID NO: 66372 - DNA, 22 bp, Artificial Sequence
  chemically synthesized
cacaatagctctatgacaaagt

SEQ ID NO: 66373 - DNA, 22 bp, Artificial Sequence
  chemically synthesized
acaatagctctatgacaaagtc

SEQ ID NO: 66374 - DNA, 22 bp, Artificial Sequence
  chemically synthesized
tatgacaaagtccacctttctc

SEQ ID NO: 66375 - DNA, 22 bp, Artificial Sequence
  chemically synthesized
tgacaaagtccacctttctcat

SEQ ID NO: 66376 - DNA, 22 bp, Artificial Sequence
  chemically synthesized
tctcatctccaggaaactgagg

SEQ ID NO: 66377 - DNA, 22 bp, Artificial Sequence
  chemically synthesized
ctcatctccaggaaactgaggt

SEQ ID NO: 66378 - DNA, 22 bp, Artificial Sequence
  chemically synthesized
tcatctccaggaaactgaggtt

SEQ ID NO: 66379 - DNA, 22 bp, Artificial Sequence
  chemically synthesized
atctccaggaaactgaggttca

SEQ ID NO: 66380 - DNA, 22 bp, Artificial Sequence
  chemically synthesized
caggaaactgaggttcagagag

SEQ ID NO: 66381 - DNA, 22 bp, Artificial Sequence
  chemically synthesized
aggttcagagaggttaagtaac

SEQ ID NO: 66382 - DNA, 22 bp, Artificial Sequence
  chemically synthesized
agagaggttaagtaacttgtcc

SEQ ID NO: 66383 - DNA, 22 bp, Artificial Sequence
  chemically synthesized
agtaacttgtccaaggtcacac

SEQ ID NO: 66384 - DNA, 22 bp, Artificial Sequence
  chemically synthesized
gtccaaggtcacacagctaata

SEQ ID NO: 66385 - DNA, 22 bp, Artificial Sequence
  chemically synthesized
tccaaggtcacacagctaatag

SEQ ID NO: 66386 - DNA, 22 bp, Artificial Sequence
  chemically synthesized
atagcaagttgacgtggagcaa

SEQ ID NO: 66387 - DNA, 22 bp, Artificial Sequence
  chemically synthesized
acgtggagcaatctggcctcag

SEQ ID NO: 66388 - DNA, 22 bp, Artificial Sequence
  chemically synthesized
gcctcagagcctttaattttag

SEQ ID NO: 66389 - DNA, 22 bp, Artificial Sequence
  chemically synthesized
agagcctttaattttagccaca

SEQ ID NO: 66390 - DNA, 22 bp, Artificial Sequence
  chemically synthesized
taattttagccacagactgatg

SEQ ID NO: 66391 - DNA, 22 bp, Artificial Sequence
  chemically synthesized
aattttagccacagactgatgc

SEQ ID NO: 66392 - DNA, 22 bp, Artificial Sequence
  chemically synthesized
attttagccacagactgatgct

SEQ ID NO: 66393 - DNA, 22 bp, Artificial Sequence
  chemically synthesized
tagccacagactgatgctcccc

SEQ ID NO: 66394 - DNA, 22 bp, Artificial Sequence
  chemically synthesized
agccacagactgatgctcccct

SEQ ID NO: 66395 - DNA, 22 bp, Artificial Sequence
  chemically synthesized
gccacagactgatgctcccctc

SEQ ID NO: 66396 - DNA, 22 bp, Artificial Sequence
  chemically synthesized
atgctcccctcttcatttagcc

SEQ ID NO: 66397 - DNA, 22 bp, Artificial Sequence
  chemically synthesized
ccctcttcatttagccaggctg

SEQ ID NO: 66398 - DNA, 22 bp, Artificial Sequence
  chemically synthesized
ttcatttagccaggctgcctct

SEQ ID NO: 66399 - DNA, 22 bp, Artificial Sequence
  chemically synthesized
catttagccaggctgcctctga

SEQ ID NO: 66400 - DNA, 22 bp, Artificial Sequence
  chemically synthesized
atttagccaggctgcctctgaa

SEQ ID NO: 66401 - DNA, 22 bp, Artificial Sequence
  chemically synthesized
agccaggctgcctctgaagttt

SEQ ID NO: 66402 - DNA, 22 bp, Artificial Sequence
  chemically synthesized
gccaggctgcctctgaagtttt

SEQ ID NO: 66403 - DNA, 22 bp, Artificial Sequence
  chemically synthesized
cctctgaagttttctgattcaa

SEQ ID NO: 66404 - DNA, 22 bp, Artificial Sequence
  chemically synthesized
tgaagttttctgattcaagact

SEQ ID NO: 66405 - DNA, 22 bp, Artificial Sequence
  chemically synthesized
aagttttctgattcaagacttc

SEQ ID NO: 66406 - DNA, 22 bp, Artificial Sequence
  chemically synthesized
tctgattcaagacttctggctt

SEQ ID NO: 66407 - DNA, 22 bp, Artificial Sequence
  chemically synthesized
ctgattcaagacttctggcttc

SEQ ID NO: 66408 - DNA, 22 bp, Artificial Sequence
  chemically synthesized
tgattcaagacttctggcttca

SEQ ID NO: 66409 - DNA, 22 bp, Artificial Sequence
  chemically synthesized
attcaagacttctggcttcagc

SEQ ID NO: 66410 - DNA, 22 bp, Artificial Sequence
  chemically synthesized
aagacttctggcttcagctttg

SEQ ID NO: 66411 - DNA, 22 bp, Artificial Sequence
  chemically synthesized
ctggcttcagctttgtacacag

SEQ ID NO: 66412 - DNA, 22 bp, Artificial Sequence
  chemically synthesized
tggcttcagctttgtacacaga

SEQ ID NO: 66413 - DNA, 22 bp, Artificial Sequence
  chemically synthesized
gcttcagctttgtacacagaga

SEQ ID NO: 66414 - DNA, 22 bp, Artificial Sequence
  chemically synthesized
cagctttgtacacagagatgat

SEQ ID NO: 66415 - DNA, 22 bp, Artificial Sequence
  chemically synthesized
agctttgtacacagagatgatt

SEQ ID NO: 66416 - DNA, 22 bp, Artificial Sequence
  chemically synthesized
tgtacacagagatgattcaatg

SEQ ID NO: 66417 - DNA, 22 bp, Artificial Sequence
  chemically synthesized
gtacacagagatgattcaatgt

SEQ ID NO: 66418 - DNA, 22 bp, Artificial Sequence
  chemically synthesized
tacacagagatgattcaatgtc

SEQ ID NO: 66419 - DNA, 22 bp, Artificial Sequence
  chemically synthesized
aatgtcaggttttggagtgaaa

SEQ ID NO: 66420 - DNA, 22 bp, Artificial Sequence
  chemically synthesized
tggagtgaaatctgtttaatcc

SEQ ID NO: 66421 - DNA, 22 bp, Artificial Sequence
  chemically synthesized
ggagtgaaatctgtttaatccc

SEQ ID NO: 66422 - DNA, 22 bp, Artificial Sequence
  chemically synthesized
gagtgaaatctgtttaatccca

SEQ ID NO: 66423 - DNA, 22 bp, Artificial Sequence
  chemically synthesized
tttaatcccagacaaaacattt

SEQ ID NO: 66424 - DNA, 22 bp, Artificial Sequence
  chemically synthesized
aatcccagacaaaacatttagg

SEQ ID NO: 66425 - DNA, 22 bp, Artificial Sequence
  chemically synthesized
atcccagacaaaacatttagga

SEQ ID NO: 66426 - DNA, 22 bp, Artificial Sequence
  chemically synthesized
aggattacatctcagttttgta

SEQ ID NO: 66427 - DNA, 22 bp, Artificial Sequence
  chemically synthesized
ggattacatctcagttttgtaa

SEQ ID NO: 66428 - DNA, 22 bp, Artificial Sequence
  chemically synthesized
catctcagttttgtaagcaagt

SEQ ID NO: 66429 - DNA, 22 bp, Artificial Sequence
  chemically synthesized
agttttgtaagcaagtagctct

SEQ ID NO: 66430 - DNA, 22 bp, Artificial Sequence
  chemically synthesized
tgtaagcaagtagctctgtgat

SEQ ID NO: 66431 - DNA, 22 bp, Artificial Sequence
  chemically synthesized
gtaagcaagtagctctgtgatt

SEQ ID NO: 66432 - DNA, 22 bp, Artificial Sequence
  chemically synthesized
taagcaagtagctctgtgattt

SEQ ID NO: 66433 - DNA, 22 bp, Artificial Sequence
  chemically synthesized
tgtgatttttagtgagttattt

SEQ ID NO: 66434 - DNA, 22 bp, Artificial Sequence
  chemically synthesized
tgatttttagtgagttatttaa

SEQ ID NO: 66435 - DNA, 22 bp, Artificial Sequence
  chemically synthesized
ttagtgagttatttaatgctct

SEQ ID NO: 66436 - DNA, 22 bp, Artificial Sequence
  chemically synthesized
tagtgagttatttaatgctctt

SEQ ID NO: 66437 - DNA, 22 bp, Artificial Sequence
  chemically synthesized
agtgagttatttaatgctcttt

SEQ ID NO: 66438 - DNA, 22 bp, Artificial Sequence
  chemically synthesized
gtgagttatttaatgctctttg

SEQ ID NO: 66439 - DNA, 22 bp, Artificial Sequence
  chemically synthesized
tttaatgctctttggggctcaa

SEQ ID NO: 66440 - DNA, 22 bp, Artificial Sequence
  chemically synthesized
aatgctctttggggctcaattt

SEQ ID NO: 66441 - DNA, 22 bp, Artificial Sequence
  chemically synthesized
atgctctttggggctcaatttt

SEQ ID NO: 66442 - DNA, 22 bp, Artificial Sequence
  chemically synthesized
tttggggctcaatttttctatc

SEQ ID NO: 66443 - DNA, 22 bp, Artificial Sequence
  chemically synthesized
tggggctcaatttttctatcta

SEQ ID NO: 66444 - DNA, 22 bp, Artificial Sequence
  chemically synthesized
ggggctcaatttttctatctat

SEQ ID NO: 66445 - DNA, 22 bp, Artificial Sequence
  chemically synthesized
gggctcaatttttctatctata

SEQ ID NO: 66446 - DNA, 22 bp, Artificial Sequence
  chemically synthesized
aatttttctatctataaaatag

SEQ ID NO: 66447 - DNA, 22 bp, Artificial Sequence
  chemically synthesized
ttctatctataaaatagggcta

SEQ ID NO: 66448 - DNA, 22 bp, Artificial Sequence
  chemically synthesized
tctatctataaaatagggctaa

SEQ ID NO: 66449 - DNA, 22 bp, Artificial Sequence
  chemically synthesized
ctatctataaaatagggctaat

SEQ ID NO: 66450 - DNA, 22 bp, Artificial Sequence
  chemically synthesized
tatctataaaatagggctaata

SEQ ID NO: 66451 - DNA, 22 bp, Artificial Sequence
  chemically synthesized
tctataaaatagggctaataat

SEQ ID NO: 66452 - DNA, 22 bp, Artificial Sequence
  chemically synthesized
taaaatagggctaataatttgc

SEQ ID NO: 66453 - DNA, 22 bp, Artificial Sequence
  chemically synthesized
ataatttgcaccttatagggta

SEQ ID NO: 66454 - DNA, 22 bp, Artificial Sequence
  chemically synthesized
gcaccttatagggtaagctttg

SEQ ID NO: 66455 - DNA, 22 bp, Artificial Sequence
  chemically synthesized
caccttatagggtaagctttga

SEQ ID NO: 66456 - DNA, 22 bp, Artificial Sequence
  chemically synthesized
atagggtaagctttgaggacag

SEQ ID NO: 66457 - DNA, 22 bp, Artificial Sequence
  chemically synthesized
tagggtaagctttgaggacaga

SEQ ID NO: 66458 - DNA, 22 bp, Artificial Sequence
  chemically synthesized
tgaggacagattagatgatacg

SEQ ID NO: 66459 - DNA, 22 bp, Artificial Sequence
  chemically synthesized
gaggacagattagatgatacgg

SEQ ID NO: 66460 - DNA, 22 bp, Artificial Sequence
  chemically synthesized
aggacagattagatgatacggt

SEQ ID NO: 66461 - DNA, 22 bp, Artificial Sequence
  chemically synthesized
gatgatacggtgcctgtaaaac

SEQ ID NO: 66462 - DNA, 22 bp, Artificial Sequence
  chemically synthesized
taaaacaccaggtgttagtaag

SEQ ID NO: 66463 - DNA, 22 bp, Artificial Sequence
  chemically synthesized
gtaagtgtggcaatgatggtga

SEQ ID NO: 66464 - DNA, 22 bp, Artificial Sequence
  chemically synthesized
aggctgatgtttgcttagcata

SEQ ID NO: 66465 - DNA, 22 bp, Artificial Sequence
  chemically synthesized
atgtttgcttagcatagggtta

SEQ ID NO: 66466 - DNA, 22 bp, Artificial Sequence
  chemically synthesized
gcttagcatagggttaggcagc

SEQ ID NO: 66467 - DNA, 22 bp, Artificial Sequence
  chemically synthesized
cttagcatagggttaggcagct

SEQ ID NO: 66468 - DNA, 22 bp, Artificial Sequence
  chemically synthesized
agcatagggttaggcagctggc

SEQ ID NO: 66469 - DNA, 22 bp, Artificial Sequence
  chemically synthesized
gcatagggttaggcagctggca

SEQ ID NO: 66470 - DNA, 22 bp, Artificial Sequence
  chemically synthesized
ggcagctggcaggcagtaaaca

SEQ ID NO: 66471 - DNA, 22 bp, Artificial Sequence
  chemically synthesized
gcaggcagtaaacagttggata

SEQ ID NO: 66472 - DNA, 22 bp, Artificial Sequence
  chemically synthesized
gataatttaatggaaaatttgc

SEQ ID NO: 66473 - DNA, 22 bp, Artificial Sequence
  chemically synthesized
aatggaaaatttgccaaactca

SEQ ID NO: 66474 - DNA, 22 bp, Artificial Sequence
  chemically synthesized
atggaaaatttgccaaactcag

SEQ ID NO: 66475 - DNA, 22 bp, Artificial Sequence
  chemically synthesized
gccaaactcagatgctgttcac

SEQ ID NO: 66476 - DNA, 22 bp, Artificial Sequence
  chemically synthesized
ccaaactcagatgctgttcact

SEQ ID NO: 66477 - DNA, 22 bp, Artificial Sequence
  chemically synthesized
agatgctgttcactgctgagca

SEQ ID NO: 66478 - DNA, 22 bp, Artificial Sequence
  chemically synthesized
ttcactgctgagcaggagcccc

SEQ ID NO: 66479 - DNA, 22 bp, Artificial Sequence
  chemically synthesized
actgctgagcaggagccccttc

SEQ ID NO: 66480 - DNA, 22 bp, Artificial Sequence
  chemically synthesized
ctgagcaggagccccttcctgc

SEQ ID NO: 66481 - DNA, 22 bp, Artificial Sequence
  chemically synthesized
agcaggagccccttcctgctga

SEQ ID NO: 66482 - DNA, 22 bp, Artificial Sequence
  chemically synthesized
cctgctgaaatggtcctgggga

SEQ ID NO: 66483 - DNA, 22 bp, Artificial Sequence
  chemically synthesized
ctgctgaaatggtcctggggag

SEQ ID NO: 66484 - DNA, 22 bp, Artificial Sequence
  chemically synthesized
ctgaaatggtcctggggagtgc

SEQ ID NO: 66485 - DNA, 22 bp, Artificial Sequence
  chemically synthesized
aaatggtcctggggagtgcagc

SEQ ID NO: 66486 - DNA, 22 bp, Artificial Sequence
  chemically synthesized
gggagtgcagcaggctctccgg

SEQ ID NO: 66487 - DNA, 22 bp, Artificial Sequence
  chemically synthesized
tccgggaagaaatctaccatct

SEQ ID NO: 66488 - DNA, 22 bp, Artificial Sequence
  chemically synthesized
cgggaagaaatctaccatctct

SEQ ID NO: 66489 - DNA, 22 bp, Artificial Sequence
  chemically synthesized
ccatctctcgggcaggagctca

SEQ ID NO: 66490 - DNA, 22 bp, Artificial Sequence
  chemically synthesized
tcgggcaggagctcaacctgtg

SEQ ID NO: 66491 - DNA, 22 bp, Artificial Sequence
  chemically synthesized
gggcaggagctcaacctgtgtg

SEQ ID NO: 66492 - DNA, 22 bp, Artificial Sequence
  chemically synthesized
aacctgtgtgcaggtacaggga

SEQ ID NO: 66493 - DNA, 22 bp, Artificial Sequence
  chemically synthesized
tgtgcaggtacagggagggctt

SEQ ID NO: 66494 - DNA, 22 bp, Artificial Sequence
  chemically synthesized
cctcacctggtgcccactcatg

SEQ ID NO: 66495 - DNA, 22 bp, Artificial Sequence
  chemically synthesized
ctcacctggtgcccactcatgc

SEQ ID NO: 66496 - DNA, 22 bp, Artificial Sequence
  chemically synthesized
acctggtgcccactcatgcatt

SEQ ID NO: 66497 - DNA, 22 bp, Artificial Sequence
  chemically synthesized
gtgcccactcatgcattacgtc

SEQ ID NO: 66498 - DNA, 22 bp, Artificial Sequence
  chemically synthesized
atgcattacgtcagttattcct

SEQ ID NO: 66499 - DNA, 22 bp, Artificial Sequence
  chemically synthesized
cgtcagttattcctcatccctg

SEQ ID NO: 66500 - DNA, 22 bp, Artificial Sequence
  chemically synthesized
ttcctcatccctgtccaaagga

SEQ ID NO: 66501 - DNA, 22 bp, Artificial Sequence
  chemically synthesized
ctcatccctgtccaaaggattc

SEQ ID NO: 66502 - DNA, 22 bp, Artificial Sequence
  chemically synthesized
atccctgtccaaaggattcttt

SEQ ID NO: 66503 - DNA, 22 bp, Artificial Sequence
  chemically synthesized
tccaaaggattcttttctccat

SEQ ID NO: 66504 - DNA, 22 bp, Artificial Sequence
  chemically synthesized
ttttctccattgtacagctatg

SEQ ID NO: 66505 - DNA, 22 bp, Artificial Sequence
  chemically synthesized
ttctccattgtacagctatgaa

SEQ ID NO: 66506 - DNA, 22 bp, Artificial Sequence
  chemically synthesized
tctccattgtacagctatgaag

SEQ ID NO: 66507 - DNA, 22 bp, Artificial Sequence
  chemically synthesized
ctccattgtacagctatgaagc

SEQ ID NO: 66508 - DNA, 22 bp, Artificial Sequence
  chemically synthesized
tccattgtacagctatgaagct

SEQ ID NO: 66509 - DNA, 22 bp, Artificial Sequence
  chemically synthesized
cattgtacagctatgaagctag

SEQ ID NO: 66510 - DNA, 22 bp, Artificial Sequence
  chemically synthesized
tacagctatgaagctagtgctc

SEQ ID NO: 66511 - DNA, 22 bp, Artificial Sequence
  chemically synthesized
tgaagctagtgctcaaagaagt

SEQ ID NO: 66512 - DNA, 22 bp, Artificial Sequence
  chemically synthesized
gtgctcaaagaagtgaagtcat

SEQ ID NO: 66513 - DNA, 22 bp, Artificial Sequence
  chemically synthesized
aaagaagtgaagtcatttaccc

SEQ ID NO: 66514 - DNA, 22 bp, Artificial Sequence
  chemically synthesized
accccaggccccctgccagtaa

SEQ ID NO: 66515 - DNA, 22 bp, Artificial Sequence
  chemically synthesized
ccccaggccccctgccagtaag

SEQ ID NO: 66516 - DNA, 22 bp, Artificial Sequence
  chemically synthesized
ccagtaagtgacagggcctggt

SEQ ID NO: 66517 - DNA, 22 bp, Artificial Sequence
  chemically synthesized
gtcacacttgggtttatttatt

SEQ ID NO: 66518 - DNA, 22 bp, Artificial Sequence
  chemically synthesized
gggtttatttattgcccagttc

SEQ ID NO: 66519 - DNA, 22 bp, Artificial Sequence
  chemically synthesized
ggtttatttattgcccagttca

SEQ ID NO: 66520 - DNA, 22 bp, Artificial Sequence
  chemically synthesized
atttattgcccagttcaacagg

SEQ ID NO: 66521 - DNA, 22 bp, Artificial Sequence
  chemically synthesized
tttattgcccagttcaacaggt

SEQ ID NO: 66522 - DNA, 22 bp, Artificial Sequence
  chemically synthesized
attgcccagttcaacaggttgt

SEQ ID NO: 66523 - DNA, 22 bp, Artificial Sequence
  chemically synthesized
ttgcccagttcaacaggttgtt

SEQ ID NO: 66524 - DNA, 22 bp, Artificial Sequence
  chemically synthesized
cccagttcaacaggttgtttga

SEQ ID NO: 66525 - DNA, 22 bp, Artificial Sequence
  chemically synthesized
aacaggttgtttgaccataggc

SEQ ID NO: 66526 - DNA, 22 bp, Artificial Sequence
  chemically synthesized
tttgaccataggcgagattctc

SEQ ID NO: 66527 - DNA, 22 bp, Artificial Sequence
  chemically synthesized
gaccataggcgagattctcttc

SEQ ID NO: 66528 - DNA, 22 bp, Artificial Sequence
  chemically synthesized
accataggcgagattctcttcc

SEQ ID NO: 66529 - DNA, 22 bp, Artificial Sequence
  chemically synthesized
tcttccctgcaccctgccgggt

SEQ ID NO: 66530 - DNA, 22 bp, Artificial Sequence
  chemically synthesized
ttccctgcaccctgccgggttg

SEQ ID NO: 66531 - DNA, 22 bp, Artificial Sequence
  chemically synthesized
ccctgcaccctgccgggttgct

SEQ ID NO: 66532 - DNA, 22 bp, Artificial Sequence
  chemically synthesized
cctgcaccctgccgggttgctc

SEQ ID NO: 66533 - DNA, 22 bp, Artificial Sequence
  chemically synthesized
caccctgccgggttgctcttgg

SEQ ID NO: 66534 - DNA, 22 bp, Artificial Sequence
  chemically synthesized
ccgggttgctcttggtccctta

SEQ ID NO: 66535 - DNA, 22 bp, Artificial Sequence
  chemically synthesized
ctcttggtcccttattttatgc

SEQ ID NO: 66536 - DNA, 22 bp, Artificial Sequence
  chemically synthesized
ttggtcccttattttatgctcc

SEQ ID NO: 66537 - DNA, 22 bp, Artificial Sequence
  chemically synthesized
ggtcccttattttatgctcccg

SEQ ID NO: 66538 - DNA, 22 bp, Artificial Sequence
  chemically synthesized
gtcccttattttatgctcccgg

SEQ ID NO: 66539 - DNA, 22 bp, Artificial Sequence
  chemically synthesized
attttatgctcccgggtagaaa

SEQ ID NO: 66540 - DNA, 22 bp, Artificial Sequence
  chemically synthesized
ttttatgctcccgggtagaaat

SEQ ID NO: 66541 - DNA, 22 bp, Artificial Sequence
  chemically synthesized
tatgctcccgggtagaaatggt

SEQ ID NO: 66542 - DNA, 22 bp, Artificial Sequence
  chemically synthesized
atgctcccgggtagaaatggtg

SEQ ID NO: 66543 - DNA, 22 bp, Artificial Sequence
  chemically synthesized
tgctcccgggtagaaatggtgt

SEQ ID NO: 66544 - DNA, 22 bp, Artificial Sequence
  chemically synthesized
ccgggtagaaatggtgtgagat

SEQ ID NO: 66545 - DNA, 22 bp, Artificial Sequence
  chemically synthesized
ggcagggagtggctcgcttccc

SEQ ID NO: 66546 - DNA, 22 bp, Artificial Sequence
  chemically synthesized
gcttccctgtccctggccccgc

SEQ ID NO: 66547 - DNA, 22 bp, Artificial Sequence
  chemically synthesized
ccctgtccctggccccgcaaag

SEQ ID NO: 66548 - DNA, 22 bp, Artificial Sequence
  chemically synthesized
cctgtccctggccccgcaaaga

SEQ ID NO: 66549 - DNA, 22 bp, Artificial Sequence
  chemically synthesized
tccctggccccgcaaagagtgc

SEQ ID NO: 66550 - DNA, 22 bp, Artificial Sequence
  chemically synthesized
gccccgcaaagagtgctcccac

SEQ ID NO: 66551 - DNA, 22 bp, Artificial Sequence
  chemically synthesized
ccacctgccccgatcccagaaa

SEQ ID NO: 66552 - DNA, 22 bp, Artificial Sequence
  chemically synthesized
ccccgatcccagaaatgtcacc

SEQ ID NO: 66553 - DNA, 22 bp, Artificial Sequence
  chemically synthesized
cattcttttggtttaaagcttg

SEQ ID NO: 66554 - DNA, 22 bp, Artificial Sequence
  chemically synthesized
attcttttggtttaaagcttgg

SEQ ID NO: 66555 - DNA, 22 bp, Artificial Sequence
  chemically synthesized
ttttggtttaaagcttggcctc

SEQ ID NO: 66556 - DNA, 22 bp, Artificial Sequence
  chemically synthesized
ttggtttaaagcttggcctcag

SEQ ID NO: 66557 - DNA, 22 bp, Artificial Sequence
  chemically synthesized
tggtttaaagcttggcctcagt

SEQ ID NO: 66558 - DNA, 22 bp, Artificial Sequence
  chemically synthesized
ggtttaaagcttggcctcagtg

SEQ ID NO: 66559 - DNA, 22 bp, Artificial Sequence
  chemically synthesized
gtttaaagcttggcctcagtgt

SEQ ID NO: 66560 - DNA, 22 bp, Artificial Sequence
  chemically synthesized
aaagcttggcctcagtgtccgt

SEQ ID NO: 66561 - DNA, 22 bp, Artificial Sequence
  chemically synthesized
aagcttggcctcagtgtccgta

SEQ ID NO: 66562 - DNA, 22 bp, Artificial Sequence
  chemically synthesized
ggcctcagtgtccgtacaccat

SEQ ID NO: 66563 - DNA, 22 bp, Artificial Sequence
  chemically synthesized
gcctcagtgtccgtacaccatg

SEQ ID NO: 66564 - DNA, 22 bp, Artificial Sequence
  chemically synthesized
agtgtccgtacaccatggggta

SEQ ID NO: 66565 - DNA, 22 bp, Artificial Sequence
  chemically synthesized
ggccagatggcgactttctcct

SEQ ID NO: 66566 - DNA, 22 bp, Artificial Sequence
  chemically synthesized
gccagatggcgactttctcctc

SEQ ID NO: 66567 - DNA, 22 bp, Artificial Sequence
  chemically synthesized
tctcctctccagtcgccctccc

SEQ ID NO: 66568 - DNA, 22 bp, Artificial Sequence
  chemically synthesized
ctcctctccagtcgccctccca

SEQ ID NO: 66569 - DNA, 22 bp, Artificial Sequence
  chemically synthesized
tcctctccagtcgccctcccag

SEQ ID NO: 66570 - DNA, 22 bp, Artificial Sequence
  chemically synthesized
ctctccagtcgccctcccaggc

SEQ ID NO: 66571 - DNA, 22 bp, Artificial Sequence
  chemically synthesized
tccagtcgccctcccaggcact

SEQ ID NO: 66572 - DNA, 22 bp, Artificial Sequence
  chemically synthesized
cagtcgccctcccaggcactag

SEQ ID NO: 66573 - DNA, 22 bp, Artificial Sequence
  chemically synthesized
ccaggcactagcttttaggagt

SEQ ID NO: 66574 - DNA, 22 bp, Artificial Sequence
  chemically synthesized
gcttttaggagtgcagggtgct

SEQ ID NO: 66575 - DNA, 22 bp, Artificial Sequence
  chemically synthesized
ttaggagtgcagggtgctgcct

SEQ ID NO: 66576 - DNA, 22 bp, Artificial Sequence
  chemically synthesized
taggagtgcagggtgctgcctc

SEQ ID NO: 66577 - DNA, 22 bp, Artificial Sequence
  chemically synthesized
aggagtgcagggtgctgcctct

SEQ ID NO: 66578 - DNA, 22 bp, Artificial Sequence
  chemically synthesized
ggagtgcagggtgctgcctctg

SEQ ID NO: 66579 - DNA, 22 bp, Artificial Sequence
  chemically synthesized
cctctgatagaagggccaggag

SEQ ID NO: 66580 - DNA, 22 bp, Artificial Sequence
  chemically synthesized
tgatagaagggccaggagagag

SEQ ID NO: 66581 - DNA, 22 bp, Artificial Sequence
  chemically synthesized
atagaagggccaggagagagca

SEQ ID NO: 66582 - DNA, 22 bp, Artificial Sequence
  chemically synthesized
tggagtcctgatgttataagga

SEQ ID NO: 66583 - DNA, 22 bp, Artificial Sequence
  chemically synthesized
ggagtcctgatgttataaggaa

SEQ ID NO: 66584 - DNA, 22 bp, Artificial Sequence
  chemically synthesized
gagtcctgatgttataaggaac

SEQ ID NO: 66585 - DNA, 22 bp, Artificial Sequence
  chemically synthesized
atgttataaggaacagcttggg

SEQ ID NO: 66586 - DNA, 22 bp, Artificial Sequence
  chemically synthesized
taaggaacagcttgggaggcat

SEQ ID NO: 66587 - DNA, 22 bp, Artificial Sequence
  chemically synthesized
gggaggcataatgaacccaaca

SEQ ID NO: 66588 - DNA, 22 bp, Artificial Sequence
  chemically synthesized
ggaggcataatgaacccaacat

SEQ ID NO: 66589 - DNA, 22 bp, Artificial Sequence
  chemically synthesized
gagaccaatgtcacagcccaat

SEQ ID NO: 66590 - DNA, 22 bp, Artificial Sequence
  chemically synthesized
agaccaatgtcacagcccaatt

SEQ ID NO: 66591 - DNA, 22 bp, Artificial Sequence
  chemically synthesized
tgacattcatcatctgagatct

SEQ ID NO: 66592 - DNA, 22 bp, Artificial Sequence
  chemically synthesized
acattcatcatctgagatctga

SEQ ID NO: 66593 - DNA, 22 bp, Artificial Sequence
  chemically synthesized
atcatctgagatctgaggacac

SEQ ID NO: 66594 - DNA, 22 bp, Artificial Sequence
  chemically synthesized
agatctgaggacacagctgtct

SEQ ID NO: 66595 - DNA, 22 bp, Artificial Sequence
  chemically synthesized
aggacacagctgtctcagttca

SEQ ID NO: 66596 - DNA, 22 bp, Artificial Sequence
  chemically synthesized
tctcagttcatgatctgagtgc

SEQ ID NO: 66597 - DNA, 22 bp, Artificial Sequence
  chemically synthesized
agttcatgatctgagtgctggg

SEQ ID NO: 66598 - DNA, 22 bp, Artificial Sequence
  chemically synthesized
atgatctgagtgctgggaaagc

SEQ ID NO: 66599 - DNA, 22 bp, Artificial Sequence
  chemically synthesized
agtgctgggaaagccaagactt

SEQ ID NO: 66600 - DNA, 22 bp, Artificial Sequence
  chemically synthesized
ggaaagccaagacttgttccag

SEQ ID NO: 66601 - DNA, 22 bp, Artificial Sequence
  chemically synthesized
gttccagctttgtcactgactt

SEQ ID NO: 66602 - DNA, 22 bp, Artificial Sequence
  chemically synthesized
ttccagctttgtcactgacttg

SEQ ID NO: 66603 - DNA, 22 bp, Artificial Sequence
  chemically synthesized
cagctttgtcactgacttgctg

SEQ ID NO: 66604 - DNA, 22 bp, Artificial Sequence
  chemically synthesized
tgtcactgacttgctgtatagc

SEQ ID NO: 66605 - DNA, 22 bp, Artificial Sequence
  chemically synthesized
gtcactgacttgctgtatagcc

SEQ ID NO: 66606 - DNA, 22 bp, Artificial Sequence
  chemically synthesized
tcactgacttgctgtatagcct

SEQ ID NO: 66607 - DNA, 22 bp, Artificial Sequence
  chemically synthesized
acttgctgtatagcctcaacaa

SEQ ID NO: 66608 - DNA, 22 bp, Artificial Sequence
  chemically synthesized
gctgtatagcctcaacaaggcc

SEQ ID NO: 66609 - DNA, 22 bp, Artificial Sequence
  chemically synthesized
ctgtatagcctcaacaaggccc

SEQ ID NO: 66610 - DNA, 22 bp, Artificial Sequence
  chemically synthesized
tatagcctcaacaaggccctga

SEQ ID NO: 66611 - DNA, 22 bp, Artificial Sequence
  chemically synthesized
aacaaggccctgaccctctctg

SEQ ID NO: 66612 - DNA, 22 bp, Artificial Sequence
  chemically synthesized
accctctctgggcttcaaactc

SEQ ID NO: 66613 - DNA, 22 bp, Artificial Sequence
  chemically synthesized
tctgggcttcaaactcttcact

SEQ ID NO: 66614 - DNA, 22 bp, Artificial Sequence
  chemically synthesized
tgggcttcaaactcttcactgt

SEQ ID NO: 66615 - DNA, 22 bp, Artificial Sequence
  chemically synthesized
ggcttcaaactcttcactgtga

SEQ ID NO: 66616 - DNA, 22 bp, Artificial Sequence
  chemically synthesized
caaactcttcactgtgaaagga

SEQ ID NO: 66617 - DNA, 22 bp, Artificial Sequence
  chemically synthesized
aaactcttcactgtgaaaggag

SEQ ID NO: 66618 - DNA, 22 bp, Artificial Sequence
  chemically synthesized
ttcactgtgaaaggaggaaacc

SEQ ID NO: 66619 - DNA, 22 bp, Artificial Sequence
  chemically synthesized
cactgtgaaaggaggaaaccag

SEQ ID NO: 66620 - DNA, 22 bp, Artificial Sequence
  chemically synthesized
actgtgaaaggaggaaaccaga

SEQ ID NO: 66621 - DNA, 22 bp, Artificial Sequence
  chemically synthesized
tgaaaggaggaaaccagagtag

SEQ ID NO: 66622 - DNA, 22 bp, Artificial Sequence
  chemically synthesized
ctcccagctgtcaccccctcgc

SEQ ID NO: 66623 - DNA, 22 bp, Artificial Sequence
  chemically synthesized
ccagctgtcaccccctcgccac

SEQ ID NO: 66624 - DNA, 22 bp, Artificial Sequence
  chemically synthesized
tcaccccctcgccaccctccct

SEQ ID NO: 66625 - DNA, 22 bp, Artificial Sequence
  chemically synthesized
gccaccctccctgcaccagcct

SEQ ID NO: 66626 - DNA, 22 bp, Artificial Sequence
  chemically synthesized
cctgcaccagcctctccacctc

SEQ ID NO: 66627 - DNA, 22 bp, Artificial Sequence
  chemically synthesized
caccagcctctccacctccttt

SEQ ID NO: 66628 - DNA, 22 bp, Artificial Sequence
  chemically synthesized
tccacctcctttgagcccagaa

SEQ ID NO: 66629 - DNA, 22 bp, Artificial Sequence
  chemically synthesized
cacctcctttgagcccagaatt

SEQ ID NO: 66630 - DNA, 22 bp, Artificial Sequence
  chemically synthesized
ctttgagcccagaattcccctg

SEQ ID NO: 66631 - DNA, 22 bp, Artificial Sequence
  chemically synthesized
tgagcccagaattcccctgtct

SEQ ID NO: 66632 - DNA, 22 bp, Artificial Sequence
  chemically synthesized
gagcccagaattcccctgtcta

SEQ ID NO: 66633 - DNA, 22 bp, Artificial Sequence
  chemically synthesized
agcccagaattcccctgtctag

SEQ ID NO: 66634 - DNA, 22 bp, Artificial Sequence
  chemically synthesized
ccctgtctaggagggcacctgt

SEQ ID NO: 66635 - DNA, 22 bp, Artificial Sequence
  chemically synthesized
tctaggagggcacctgtctcat

SEQ ID NO: 66636 - DNA, 22 bp, Artificial Sequence
  chemically synthesized
ggagggcacctgtctcatgcct

SEQ ID NO: 66637 - DNA, 22 bp, Artificial Sequence
  chemically synthesized
tctcatgcctagccatgggaat

SEQ ID NO: 66638 - DNA, 22 bp, Artificial Sequence
  chemically synthesized
atgcctagccatgggaattctc

SEQ ID NO: 66639 - DNA, 22 bp, Artificial Sequence
  chemically synthesized
gccatgggaattctccatctgt

SEQ ID NO: 66640 - DNA, 22 bp, Artificial Sequence
  chemically synthesized
tccatctgttttgctacattga

SEQ ID NO: 66641 - DNA, 22 bp, Artificial Sequence
  chemically synthesized
catctgttttgctacattgaac

SEQ ID NO: 66642 - DNA, 22 bp, Artificial Sequence
  chemically synthesized
ttttgctacattgaacccagat

SEQ ID NO: 66643 - DNA, 22 bp, Artificial Sequence
  chemically synthesized
tgctacattgaacccagatgcc

SEQ ID NO: 66644 - DNA, 22 bp, Artificial Sequence
  chemically synthesized
gctacattgaacccagatgcca

SEQ ID NO: 66645 - DNA, 22 bp, Artificial Sequence
  chemically synthesized
ctacattgaacccagatgccat

SEQ ID NO: 66646 - DNA, 22 bp, Artificial Sequence
  chemically synthesized
cattgaacccagatgccattct

SEQ ID NO: 66647 - DNA, 22 bp, Artificial Sequence
  chemically synthesized
aacccagatgccattctaacca

SEQ ID NO: 66648 - DNA, 22 bp, Artificial Sequence
  chemically synthesized
taaccaagaatcctggctgggt

SEQ ID NO: 66649 - DNA, 22 bp, Artificial Sequence
  chemically synthesized
accaagaatcctggctgggtgc

SEQ ID NO: 66650 - DNA, 22 bp, Artificial Sequence
  chemically synthesized
gctgggtgcaggggctctcgcc

SEQ ID NO: 66651 - DNA, 22 bp, Artificial Sequence
  chemically synthesized
ggtgcaggggctctcgcctgta

SEQ ID NO: 66652 - DNA, 22 bp, Artificial Sequence
  chemically synthesized
tcgcctgtaaccccagcacttt

SEQ ID NO: 66653 - DNA, 22 bp, Artificial Sequence
  chemically synthesized
gcctgtaaccccagcactttgg

SEQ ID NO: 66654 - DNA, 22 bp, Artificial Sequence
  chemically synthesized
taaccccagcactttgggaggc

SEQ ID NO: 66655 - DNA, 22 bp, Artificial Sequence
  chemically synthesized
tgggaggccaaggcaggcggat

SEQ ID NO: 66656 - DNA, 22 bp, Artificial Sequence
  chemically synthesized
gggaggccaaggcaggcggatc

SEQ ID NO: 66657 - DNA, 22 bp, Artificial Sequence
  chemically synthesized
ggaggccaaggcaggcggatca

SEQ ID NO: 66658 - DNA, 22 bp, Artificial Sequence
  chemically synthesized
aagacctgcctggccaacacgg

SEQ ID NO: 66659 - DNA, 22 bp, Artificial Sequence
  chemically synthesized
cctggccaacacggtgaaacct

SEQ ID NO: 66660 - DNA, 22 bp, Artificial Sequence
  chemically synthesized
gccaacacggtgaaacctcagc

SEQ ID NO: 66661 - DNA, 22 bp, Artificial Sequence
  chemically synthesized
agctctactaaaaatacaaaaa

SEQ ID NO: 66662 - DNA, 22 bp, Artificial Sequence
  chemically synthesized
tactaaaaatacaaaaattagc

SEQ ID NO: 66663 - DNA, 22 bp, Artificial Sequence
  chemically synthesized
ctaaaaatacaaaaattagcca

SEQ ID NO: 66664 - DNA, 22 bp, Artificial Sequence
  chemically synthesized
aaaatacaaaaattagccaggc

SEQ ID NO: 66665 - DNA, 22 bp, Artificial Sequence
  chemically synthesized
gccaggcgtggtggcacacgcc

SEQ ID NO: 66666 - DNA, 22 bp, Artificial Sequence
  chemically synthesized
taatcccagctatttgggaagc

SEQ ID NO: 66667 - DNA, 22 bp, Artificial Sequence
  chemically synthesized
tttgggaagctgagacagaaga

SEQ ID NO: 66668 - DNA, 22 bp, Artificial Sequence
  chemically synthesized
gggaagctgagacagaagaatt

SEQ ID NO: 66669 - DNA, 22 bp, Artificial Sequence
  chemically synthesized
ggaagctgagacagaagaattt

SEQ ID NO: 66670 - DNA, 22 bp, Artificial Sequence
  chemically synthesized
agacagaagaatttcttgaacc

SEQ ID NO: 66671 - DNA, 22 bp, Artificial Sequence
  chemically synthesized
cttgaacccgggaggtggaggt

SEQ ID NO: 66672 - DNA, 22 bp, Artificial Sequence
  chemically synthesized
ttgaacccgggaggtggaggtt

SEQ ID NO: 66673 - DNA, 22 bp, Artificial Sequence
  chemically synthesized
gaacccgggaggtggaggtttc

SEQ ID NO: 66674 - DNA, 22 bp, Artificial Sequence
  chemically synthesized
aacccgggaggtggaggtttca

SEQ ID NO: 66675 - DNA, 22 bp, Artificial Sequence
  chemically synthesized
cagtgagccgagatcacgccac

SEQ ID NO: 66676 - DNA, 22 bp, Artificial Sequence
  chemically synthesized
agtgagccgagatcacgccact

SEQ ID NO: 66677 - DNA, 22 bp, Artificial Sequence
  chemically synthesized
cactccaccctggcagataaag

SEQ ID NO: 66678 - DNA, 22 bp, Artificial Sequence
  chemically synthesized
caccctggcagataaagcgaga

SEQ ID NO: 66679 - DNA, 22 bp, Artificial Sequence
  chemically synthesized
gcagataaagcgagactctgtc

SEQ ID NO: 66680 - DNA, 22 bp, Artificial Sequence
  chemically synthesized
tgtctcaaaaaaaacccaaaaa

SEQ ID NO: 66681 - DNA, 22 bp, Artificial Sequence
  chemically synthesized
tctcaaaaaaaacccaaaaacc

SEQ ID NO: 66682 - DNA, 22 bp, Artificial Sequence
  chemically synthesized
aaaaaaaacccaaaaacctatg

SEQ ID NO: 66683 - DNA, 22 bp, Artificial Sequence
  chemically synthesized
tgttagtgtacagagggcccca

SEQ ID NO: 66684 - DNA, 22 bp, Artificial Sequence
  chemically synthesized
gtgtacagagggccccagtgaa

SEQ ID NO: 66685 - DNA, 22 bp, Artificial Sequence
  chemically synthesized
ctcccagccccactttgcacaa

SEQ ID NO: 66686 - DNA, 22 bp, Artificial Sequence
  chemically synthesized
tcccagccccactttgcacaac

SEQ ID NO: 66687 - DNA, 22 bp, Artificial Sequence
  chemically synthesized
ccagccccactttgcacaactg

SEQ ID NO: 66688 - DNA, 22 bp, Artificial Sequence
  chemically synthesized
tgcacaactggggagagtgagg

SEQ ID NO: 66689 - DNA, 22 bp, Artificial Sequence
  chemically synthesized
gcacaactggggagagtgaggc

SEQ ID NO: 66690 - DNA, 22 bp, Artificial Sequence
  chemically synthesized
cacaactggggagagtgaggcc

SEQ ID NO: 66691 - DNA, 22 bp, Artificial Sequence
  chemically synthesized
gggagagtgaggccccaggacc

SEQ ID NO: 66692 - DNA, 22 bp, Artificial Sequence
  chemically synthesized
ttgctaaaggccaagtggatag

SEQ ID NO: 66693 - DNA, 22 bp, Artificial Sequence
  chemically synthesized
gctaaaggccaagtggatagtg

SEQ ID NO: 66694 - DNA, 22 bp, Artificial Sequence
  chemically synthesized
ctaaaggccaagtggatagtga

SEQ ID NO: 66695 - DNA, 22 bp, Artificial Sequence
  chemically synthesized
aaggccaagtggatagtgatgg

SEQ ID NO: 66696 - DNA, 22 bp, Artificial Sequence
  chemically synthesized
ccagggctagaagccacaacct

SEQ ID NO: 66697 - DNA, 22 bp, Artificial Sequence
  chemically synthesized
gaagccacaacctctggccctg

SEQ ID NO: 66698 - DNA, 22 bp, Artificial Sequence
  chemically synthesized
tggccctgaggccactcagcat

SEQ ID NO: 66699 - DNA, 22 bp, Artificial Sequence
  chemically synthesized
gccctgaggccactcagcatat

SEQ ID NO: 66700 - DNA, 22 bp, Artificial Sequence
  chemically synthesized
aggccactcagcatatttagtg

SEQ ID NO: 66701 - DNA, 22 bp, Artificial Sequence
  chemically synthesized
agcatatttagtgtccccaccc

SEQ ID NO: 66702 - DNA, 22 bp, Artificial Sequence
  chemically synthesized
agtgtccccaccctgcagaggc

SEQ ID NO: 66703 - DNA, 22 bp, Artificial Sequence
  chemically synthesized
gtgtccccaccctgcagaggcc

SEQ ID NO: 66704 - DNA, 22 bp, Artificial Sequence
  chemically synthesized
cagaggcccaactccctcctga

SEQ ID NO: 66705 - DNA, 22 bp, Artificial Sequence
  chemically synthesized
cctcctgaccactgagccctgt

SEQ ID NO: 66706 - DNA, 22 bp, Artificial Sequence
  chemically synthesized
ctgaccactgagccctgtaatg

SEQ ID NO: 66707 - DNA, 22 bp, Artificial Sequence
  chemically synthesized
accactgagccctgtaatgatg

SEQ ID NO: 66708 - DNA, 22 bp, Artificial Sequence
  chemically synthesized
agccctgtaatgatgggggaat

SEQ ID NO: 66709 - DNA, 22 bp, Artificial Sequence
  chemically synthesized
taatgatgggggaatttccata

SEQ ID NO: 66710 - DNA, 22 bp, Artificial Sequence
  chemically synthesized
ccataagccatgaaggactgca

SEQ ID NO: 66711 - DNA, 22 bp, Artificial Sequence
  chemically synthesized
cataagccatgaaggactgcac

SEQ ID NO: 66712 - DNA, 22 bp, Artificial Sequence
  chemically synthesized
cacaaagttcagttgggaagtg

SEQ ID NO: 66713 - DNA, 22 bp, Artificial Sequence
  chemically synthesized
agttgggaagtgaaagagaaat

SEQ ID NO: 66714 - DNA, 22 bp, Artificial Sequence
  chemically synthesized
ggaagtgaaagagaaattaaag

SEQ ID NO: 66715 - DNA, 22 bp, Artificial Sequence
  chemically synthesized
aagggagatggaaatatacagc

SEQ ID NO: 66716 - DNA, 22 bp, Artificial Sequence
  chemically synthesized
attttagcaccgtctttagttc

SEQ ID NO: 66717 - DNA, 22 bp, Artificial Sequence
  chemically synthesized
tagcaccgtctttagttctaac

SEQ ID NO: 66718 - DNA, 22 bp, Artificial Sequence
  chemically synthesized
agcaccgtctttagttctaaca

SEQ ID NO: 66719 - DNA, 22 bp, Artificial Sequence
  chemically synthesized
gcaccgtctttagttctaacaa

SEQ ID NO: 66720 - DNA, 22 bp, Artificial Sequence
  chemically synthesized
tagttctaacaacactagctag

SEQ ID NO: 66721 - DNA, 22 bp, Artificial Sequence
  chemically synthesized
agttctaacaacactagctagc

SEQ ID NO: 66722 - DNA, 22 bp, Artificial Sequence
  chemically synthesized
gttctaacaacactagctagct

SEQ ID NO: 66723 - DNA, 22 bp, Artificial Sequence
  chemically synthesized
taacaacactagctagctgaag

SEQ ID NO: 66724 - DNA, 22 bp, Artificial Sequence
  chemically synthesized
acaacactagctagctgaagaa

SEQ ID NO: 66725 - DNA, 22 bp, Artificial Sequence
  chemically synthesized
gctagctgaagaaaaatacaaa

SEQ ID NO: 66726 - DNA, 22 bp, Artificial Sequence
  chemically synthesized
gctgaagaaaaatacaaacatg

SEQ ID NO: 66727 - DNA, 22 bp, Artificial Sequence
  chemically synthesized
aagaaaaatacaaacatgtatt

SEQ ID NO: 66728 - DNA, 22 bp, Artificial Sequence
  chemically synthesized
tgtaatgtgtggtctgttccat

SEQ ID NO: 66729 - DNA, 22 bp, Artificial Sequence
  chemically synthesized
ttccatttggattacttagagg

SEQ ID NO: 66730 - DNA, 22 bp, Artificial Sequence
  chemically synthesized
catttggattacttagaggcac

SEQ ID NO: 66731 - DNA, 22 bp, Artificial Sequence
  chemically synthesized
ggattacttagaggcacgaggg

SEQ ID NO: 66732 - DNA, 22 bp, Artificial Sequence
  chemically synthesized
gattacttagaggcacgagggc

SEQ ID NO: 66733 - DNA, 22 bp, Artificial Sequence
  chemically synthesized
cttagaggcacgagggccagga

SEQ ID NO: 66734 - DNA, 22 bp, Artificial Sequence
  chemically synthesized
agaggcacgagggccaggagaa

SEQ ID NO: 66735 - DNA, 22 bp, Artificial Sequence
  chemically synthesized
gaggcacgagggccaggagaaa

SEQ ID NO: 66736 - DNA, 22 bp, Artificial Sequence
  chemically synthesized
tgcacttcatttgttgctttat

SEQ ID NO: 66737 - DNA, 22 bp, Artificial Sequence
  chemically synthesized
gcacttcatttgttgctttatt

SEQ ID NO: 66738 - DNA, 22 bp, Artificial Sequence
  chemically synthesized
cacttcatttgttgctttattg

SEQ ID NO: 66739 - DNA, 22 bp, Artificial Sequence
  chemically synthesized
catttgttgctttattggaagg

SEQ ID NO: 66740 - DNA, 22 bp, Artificial Sequence
  chemically synthesized
atttgttgctttattggaagga

SEQ ID NO: 66741 - DNA, 22 bp, Artificial Sequence
  chemically synthesized
gttgctttattggaaggaaact

SEQ ID NO: 66742 - DNA, 22 bp, Artificial Sequence
  chemically synthesized
ttgctttattggaaggaaactt

SEQ ID NO: 66743 - DNA, 22 bp, Artificial Sequence
  chemically synthesized
ctttattggaaggaaactttta

SEQ ID NO: 66744 - DNA, 22 bp, Artificial Sequence
  chemically synthesized
tattggaaggaaacttttaaaa

SEQ ID NO: 66745 - DNA, 22 bp, Artificial Sequence
  chemically synthesized
attggaaggaaacttttaaaag

SEQ ID NO: 66746 - DNA, 22 bp, Artificial Sequence
  chemically synthesized
ttggaaggaaacttttaaaagt

SEQ ID NO: 66747 - DNA, 22 bp, Artificial Sequence
  chemically synthesized
gaaggaaacttttaaaagtcca

SEQ ID NO: 66748 - DNA, 22 bp, Artificial Sequence
  chemically synthesized
ttaaaagtccaagggggttgaa

SEQ ID NO: 66749 - DNA, 22 bp, Artificial Sequence
  chemically synthesized
taaaagtccaagggggttgaag

SEQ ID NO: 66750 - DNA, 22 bp, Artificial Sequence
  chemically synthesized
aaaagtccaagggggttgaaga

SEQ ID NO: 66751 - DNA, 22 bp, Artificial Sequence
  chemically synthesized
aaagtccaagggggttgaagaa

SEQ ID NO: 66752 - DNA, 22 bp, Artificial Sequence
  chemically synthesized
aagaatctcaatatttgttatt

SEQ ID NO: 66753 - DNA, 22 bp, Artificial Sequence
  chemically synthesized
aatatttgttatttccagcttt

SEQ ID NO: 66754 - DNA, 22 bp, Artificial Sequence
  chemically synthesized
gttatttccagctttttttctc

SEQ ID NO: 66755 - DNA, 22 bp, Artificial Sequence
  chemically synthesized
ttatttccagctttttttctcc

SEQ ID NO: 66756 - DNA, 22 bp, Artificial Sequence
  chemically synthesized
tttccagctttttttctccagt

SEQ ID NO: 66757 - DNA, 22 bp, Artificial Sequence
  chemically synthesized
ccagctttttttctccagtttt

SEQ ID NO: 66758 - DNA, 22 bp, Artificial Sequence
  chemically synthesized
cagctttttttctccagttttt

SEQ ID NO: 66759 - DNA, 22 bp, Artificial Sequence
  chemically synthesized
tttttctccagtttttcatttc

SEQ ID NO: 66760 - DNA, 22 bp, Artificial Sequence
  chemically synthesized
ttttctccagtttttcatttcc

SEQ ID NO: 66761 - DNA, 22 bp, Artificial Sequence
  chemically synthesized
tttctccagtttttcatttccc

SEQ ID NO: 66762 - DNA, 22 bp, Artificial Sequence
  chemically synthesized
ttctccagtttttcatttccca

SEQ ID NO: 66763 - DNA, 22 bp, Artificial Sequence
  chemically synthesized
tctccagtttttcatttcccaa

SEQ ID NO: 66764 - DNA, 22 bp, Artificial Sequence
  chemically synthesized
ctccagtttttcatttcccaaa

SEQ ID NO: 66765 - DNA, 22 bp, Artificial Sequence
  chemically synthesized
tccagtttttcatttcccaaat

SEQ ID NO: 66766 - DNA, 22 bp, Artificial Sequence
  chemically synthesized
cagtttttcatttcccaaattc

SEQ ID NO: 66767 - DNA, 22 bp, Artificial Sequence
  chemically synthesized
ttcatttcccaaattcaaggac

SEQ ID NO: 66768 - DNA, 22 bp, Artificial Sequence
  chemically synthesized
tcatttcccaaattcaaggaca

SEQ ID NO: 66769 - DNA, 22 bp, Artificial Sequence
  chemically synthesized
catttcccaaattcaaggacac

SEQ ID NO: 66770 - DNA, 22 bp, Artificial Sequence
  chemically synthesized
atttcccaaattcaaggacacc

SEQ ID NO: 66771 - DNA, 22 bp, Artificial Sequence
  chemically synthesized
cccaaattcaaggacacctttt

SEQ ID NO: 66772 - DNA, 22 bp, Artificial Sequence
  chemically synthesized
ccaaattcaaggacaccttttt

SEQ ID NO: 66773 - DNA, 22 bp, Artificial Sequence
  chemically synthesized
aaggacacctttttctttgtat

SEQ ID NO: 66774 - DNA, 22 bp, Artificial Sequence
  chemically synthesized
tttctttgtattttgttaagat

SEQ ID NO: 66775 - DNA, 22 bp, Artificial Sequence
  chemically synthesized
ttctttgtattttgttaagatg

SEQ ID NO: 66776 - DNA, 22 bp, Artificial Sequence
  chemically synthesized
tctttgtattttgttaagatga

SEQ ID NO: 66777 - DNA, 22 bp, Artificial Sequence
  chemically synthesized
ctttgtattttgttaagatgat

SEQ ID NO: 66778 - DNA, 22 bp, Artificial Sequence
  chemically synthesized
tttgtattttgttaagatgatg

SEQ ID NO: 66779 - DNA, 22 bp, Artificial Sequence
  chemically synthesized
tgtattttgttaagatgatggt

SEQ ID NO: 66780 - DNA, 22 bp, Artificial Sequence
  chemically synthesized
gtattttgttaagatgatggtt

SEQ ID NO: 66781 - DNA, 22 bp, Artificial Sequence
  chemically synthesized
tattttgttaagatgatggttt

SEQ ID NO: 66782 - DNA, 22 bp, Artificial Sequence
  chemically synthesized
tgttaagatgatggttttggtt

SEQ ID NO: 66783 - DNA, 22 bp, Artificial Sequence
  chemically synthesized
gttaagatgatggttttggttt

SEQ ID NO: 66784 - DNA, 22 bp, Artificial Sequence
  chemically synthesized
ttaagatgatggttttggtttt

SEQ ID NO: 66785 - DNA, 22 bp, Artificial Sequence
  chemically synthesized
agatgatggttttggttttgtg

SEQ ID NO: 66786 - DNA, 22 bp, Artificial Sequence
  chemically synthesized
tggttttgtgactagtagttaa

SEQ ID NO: 66787 - DNA, 22 bp, Artificial Sequence
  chemically synthesized
ggttttgtgactagtagttaac

SEQ ID NO: 66788 - DNA, 22 bp, Artificial Sequence
  chemically synthesized
gttttgtgactagtagttaaca

SEQ ID NO: 66789 - DNA, 22 bp, Artificial Sequence
  chemically synthesized
tgtgactagtagttaacaatgt

SEQ ID NO: 66790 - DNA, 22 bp, Artificial Sequence
  chemically synthesized
gtgactagtagttaacaatgtg

SEQ ID NO: 66791 - DNA, 22 bp, Artificial Sequence
  chemically synthesized
tgactagtagttaacaatgtgg

SEQ ID NO: 66792 - DNA, 22 bp, Artificial Sequence
  chemically synthesized
gtagttaacaatgtggctgccg

SEQ ID NO: 66793 - DNA, 22 bp, Artificial Sequence
  chemically synthesized
acaatgtggctgccgggcatat

SEQ ID NO: 66794 - DNA, 22 bp, Artificial Sequence
  chemically synthesized
ccgggcatattctcctcagcta

SEQ ID NO: 66795 - DNA, 22 bp, Artificial Sequence
  chemically synthesized
tcctcagctaggacctcagttt

SEQ ID NO: 66796 - DNA, 22 bp, Artificial Sequence
  chemically synthesized
ctcagctaggacctcagttttc

SEQ ID NO: 66797 - DNA, 22 bp, Artificial Sequence
  chemically synthesized
agctaggacctcagttttccca

SEQ ID NO: 66798 - DNA, 22 bp, Artificial Sequence
  chemically synthesized
ggacctcagttttcccatctgt

SEQ ID NO: 66799 - DNA, 22 bp, Artificial Sequence
  chemically synthesized
agttttcccatctgtgaagacg

SEQ ID NO: 66800 - DNA, 22 bp, Artificial Sequence
  chemically synthesized
tcccatctgtgaagacggcagg

SEQ ID NO: 66801 - DNA, 22 bp, Artificial Sequence
  chemically synthesized
cccatctgtgaagacggcaggt

SEQ ID NO: 66802 - DNA, 22 bp, Artificial Sequence
  chemically synthesized
ccatctgtgaagacggcaggtt

SEQ ID NO: 66803 - DNA, 22 bp, Artificial Sequence
  chemically synthesized
tgaagacggcaggttctaccta

SEQ ID NO: 66804 - DNA, 22 bp, Artificial Sequence
  chemically synthesized
tacctagggggctgcaggctgg

SEQ ID NO: 66805 - DNA, 22 bp, Artificial Sequence
  chemically synthesized
cctagggggctgcaggctggtg

SEQ ID NO: 66806 - DNA, 22 bp, Artificial Sequence
  chemically synthesized
gggggctgcaggctggtggtcc

SEQ ID NO: 66807 - DNA, 22 bp, Artificial Sequence
  chemically synthesized
caggctggtggtccgaagcctg

SEQ ID NO: 66808 - DNA, 22 bp, Artificial Sequence
  chemically synthesized
gtggtccgaagcctgggcatat

SEQ ID NO: 66809 - DNA, 22 bp, Artificial Sequence
  chemically synthesized
ggcatatctggagtagaaggat

SEQ ID NO: 66810 - DNA, 22 bp, Artificial Sequence
  chemically synthesized
gagtagaaggatcactgtgggg

SEQ ID NO: 66811 - DNA, 22 bp, Artificial Sequence
  chemically synthesized
tggggcagggcaggttctgtgt

SEQ ID NO: 66812 - DNA, 22 bp, Artificial Sequence
  chemically synthesized
tgtgttgctgtggatgacgttg

SEQ ID NO: 66813 - DNA, 22 bp, Artificial Sequence
  chemically synthesized
tgttgctgtggatgacgttgac

SEQ ID NO: 66814 - DNA, 22 bp, Artificial Sequence
  chemically synthesized
ctgtggatgacgttgactttga

SEQ ID NO: 66815 - DNA, 22 bp, Artificial Sequence
  chemically synthesized
tggatgacgttgactttgacca

SEQ ID NO: 66816 - DNA, 22 bp, Artificial Sequence
  chemically synthesized
actttgaccattgctcggcaga

SEQ ID NO: 66817 - DNA, 22 bp, Artificial Sequence
  chemically synthesized
tgaccattgctcggcagagcct

SEQ ID NO: 66818 - DNA, 22 bp, Artificial Sequence
  chemically synthesized
gaccattgctcggcagagcctg

SEQ ID NO: 66819 - DNA, 22 bp, Artificial Sequence
  chemically synthesized
accattgctcggcagagcctgc

SEQ ID NO: 66820 - DNA, 22 bp, Artificial Sequence
  chemically synthesized
ctcggcagagcctgctctcgct

SEQ ID NO: 66821 - DNA, 22 bp, Artificial Sequence
  chemically synthesized
ggcagagcctgctctcgctggt

SEQ ID NO: 66822 - DNA, 22 bp, Artificial Sequence
  chemically synthesized
ctctcgctggttcagccacagg

SEQ ID NO: 66823 - DNA, 22 bp, Artificial Sequence
  chemically synthesized
tcgctggttcagccacaggccc

SEQ ID NO: 66824 - DNA, 22 bp, Artificial Sequence
  chemically synthesized
gctggttcagccacaggcccca

SEQ ID NO: 66825 - DNA, 22 bp, Artificial Sequence
  chemically synthesized
gttcagccacaggccccaccac

SEQ ID NO: 66826 - DNA, 22 bp, Artificial Sequence
  chemically synthesized
agccacaggccccaccactccc

SEQ ID NO: 66827 - DNA, 22 bp, Artificial Sequence
  chemically synthesized
cctattgtctcagccccgggta

SEQ ID NO: 66828 - DNA, 22 bp, Artificial Sequence
  chemically synthesized
ttgtctcagccccgggtatgaa

SEQ ID NO: 66829 - DNA, 22 bp, Artificial Sequence
  chemically synthesized
tctcagccccgggtatgaaaca

SEQ ID NO: 66830 - DNA, 22 bp, Artificial Sequence
  chemically synthesized
agccccgggtatgaaacatgta

SEQ ID NO: 66831 - DNA, 22 bp, Artificial Sequence
  chemically synthesized
ctcactggcctatcacctgaag

SEQ ID NO: 66832 - DNA, 22 bp, Artificial Sequence
  chemically synthesized
actggcctatcacctgaagcct

SEQ ID NO: 66833 - DNA, 22 bp, Artificial Sequence
  chemically synthesized
gcctatcacctgaagcctttga

SEQ ID NO: 66834 - DNA, 22 bp, Artificial Sequence
  chemically synthesized
tcacctgaagcctttgaatttg

SEQ ID NO: 66835 - DNA, 22 bp, Artificial Sequence
  chemically synthesized
aagcctttgaatttgcaacacc

SEQ ID NO: 66836 - DNA, 22 bp, Artificial Sequence
  chemically synthesized
tgaatttgcaacacctgccaac

SEQ ID NO: 66837 - DNA, 22 bp, Artificial Sequence
  chemically synthesized
gaatttgcaacacctgccaacc

SEQ ID NO: 66838 - DNA, 22 bp, Artificial Sequence
  chemically synthesized
aatttgcaacacctgccaaccc

SEQ ID NO: 66839 - DNA, 22 bp, Artificial Sequence
  chemically synthesized
gcaacacctgccaacccctccc

SEQ ID NO: 66840 - DNA, 22 bp, Artificial Sequence
  chemically synthesized
caacacctgccaacccctccct

SEQ ID NO: 66841 - DNA, 22 bp, Artificial Sequence
  chemically synthesized
ccaacccctccctcaaaagagt

SEQ ID NO: 66842 - DNA, 22 bp, Artificial Sequence
  chemically synthesized
cctcaaaagagttgccctctca

SEQ ID NO: 66843 - DNA, 22 bp, Artificial Sequence
  chemically synthesized
aaaagagttgccctctcagatc

SEQ ID NO: 66844 - DNA, 22 bp, Artificial Sequence
  chemically synthesized
ccctctcagatccttttgatgt

SEQ ID NO: 66845 - DNA, 22 bp, Artificial Sequence
  chemically synthesized
tcagatccttttgatgtaaggt

SEQ ID NO: 66846 - DNA, 22 bp, Artificial Sequence
  chemically synthesized
agatccttttgatgtaaggttt

SEQ ID NO: 66847 - DNA, 22 bp, Artificial Sequence
  chemically synthesized
ttgatgtaaggtttggtgttga

SEQ ID NO: 66848 - DNA, 22 bp, Artificial Sequence
  chemically synthesized
tgatgtaaggtttggtgttgag

SEQ ID NO: 66849 - DNA, 22 bp, Artificial Sequence
  chemically synthesized
gatgtaaggtttggtgttgaga

SEQ ID NO: 66850 - DNA, 22 bp, Artificial Sequence
  chemically synthesized
atgtaaggtttggtgttgagac

SEQ ID NO: 66851 - DNA, 22 bp, Artificial Sequence
  chemically synthesized
ggtgttgagacttatttcacta

SEQ ID NO: 66852 - DNA, 22 bp, Artificial Sequence
  chemically synthesized
gtgttgagacttatttcactaa

SEQ ID NO: 66853 - DNA, 22 bp, Artificial Sequence
  chemically synthesized
agacttatttcactaaattctc

SEQ ID NO: 66854 - DNA, 22 bp, Artificial Sequence
  chemically synthesized
atttcactaaattctcatacat

SEQ ID NO: 66855 - DNA, 22 bp, Artificial Sequence
  chemically synthesized
tttcactaaattctcatacata

SEQ ID NO: 66856 - DNA, 22 bp, Artificial Sequence
  chemically synthesized
cactaaattctcatacataaac

SEQ ID NO: 66857 - DNA, 22 bp, Artificial Sequence
  chemically synthesized
actaaattctcatacataaaca

SEQ ID NO: 66858 - DNA, 22 bp, Artificial Sequence
  chemically synthesized
aattctcatacataaacatcac

SEQ ID NO: 66859 - DNA, 22 bp, Artificial Sequence
  chemically synthesized
tcatacataaacatcactttat

SEQ ID NO: 66860 - DNA, 22 bp, Artificial Sequence
  chemically synthesized
atacataaacatcactttatgt

SEQ ID NO: 66861 - DNA, 22 bp, Artificial Sequence
  chemically synthesized
tatgtatgaggcaaaatgagga

SEQ ID NO: 66862 - DNA, 22 bp, Artificial Sequence
  chemically synthesized
atgtatgaggcaaaatgaggac

SEQ ID NO: 66863 - DNA, 22 bp, Artificial Sequence
  chemically synthesized
tgtatgaggcaaaatgaggacc

SEQ ID NO: 66864 - DNA, 22 bp, Artificial Sequence
  chemically synthesized
gtcctggctcatacacctggaa

SEQ ID NO: 66865 - DNA, 22 bp, Artificial Sequence
  chemically synthesized
tcctggctcatacacctggaaa

SEQ ID NO: 66866 - DNA, 22 bp, Artificial Sequence
  chemically synthesized
gctcatacacctggaaagtgac

SEQ ID NO: 66867 - DNA, 22 bp, Artificial Sequence
  chemically synthesized
atacacctggaaagtgacagag

SEQ ID NO: 66868 - DNA, 22 bp, Artificial Sequence
  chemically synthesized
gaaagtgacagagtcagattag

SEQ ID NO: 66869 - DNA, 22 bp, Artificial Sequence
  chemically synthesized
gatcccaggtctatctgaagtt

SEQ ID NO: 66870 - DNA, 22 bp, Artificial Sequence
  chemically synthesized
tctgaagttaaaagaggtgtct

SEQ ID NO: 66871 - DNA, 22 bp, Artificial Sequence
  chemically synthesized
aagttaaaagaggtgtcttttc

SEQ ID NO: 66872 - DNA, 22 bp, Artificial Sequence
  chemically synthesized
aaagaggtgtcttttcacttcc

SEQ ID NO: 66873 - DNA, 22 bp, Artificial Sequence
  chemically synthesized
ttcacttcccacctcctccatc

SEQ ID NO: 66874 - DNA, 22 bp, Artificial Sequence
  chemically synthesized
tcacttcccacctcctccatct

SEQ ID NO: 66875 - DNA, 22 bp, Artificial Sequence
  chemically synthesized
cacttcccacctcctccatcta

SEQ ID NO: 66876 - DNA, 22 bp, Artificial Sequence
  chemically synthesized
acttcccacctcctccatctac

SEQ ID NO: 66877 - DNA, 22 bp, Artificial Sequence
  chemically synthesized
cccacctcctccatctacttta

SEQ ID NO: 66878 - DNA, 22 bp, Artificial Sequence
  chemically synthesized
ccacctcctccatctactttaa

SEQ ID NO: 66879 - DNA, 22 bp, Artificial Sequence
  chemically synthesized
ctccatctactttaaagcagca

SEQ ID NO: 66880 - DNA, 22 bp, Artificial Sequence
  chemically synthesized
catctactttaaagcagcacaa

SEQ ID NO: 66881 - DNA, 22 bp, Artificial Sequence
  chemically synthesized
ctttaaagcagcacaaacccct

SEQ ID NO: 66882 - DNA, 22 bp, Artificial Sequence
  chemically synthesized
taaagcagcacaaacccctgct

SEQ ID NO: 66883 - DNA, 22 bp, Artificial Sequence
  chemically synthesized
aaagcagcacaaacccctgctt

SEQ ID NO: 66884 - DNA, 22 bp, Artificial Sequence
  chemically synthesized
aagcagcacaaacccctgcttt

SEQ ID NO: 66885 - DNA, 22 bp, Artificial Sequence
  chemically synthesized
ctttcaaggagagatgagcgtc

SEQ ID NO: 66886 - DNA, 22 bp, Artificial Sequence
  chemically synthesized
tcaaggagagatgagcgtctct

SEQ ID NO: 66887 - DNA, 22 bp, Artificial Sequence
  chemically synthesized
caaggagagatgagcgtctcta

SEQ ID NO: 66888 - DNA, 22 bp, Artificial Sequence
  chemically synthesized
aaggagagatgagcgtctctaa

SEQ ID NO: 66889 - DNA, 22 bp, Artificial Sequence
  chemically synthesized
taaagcccctgacagcaagagc

SEQ ID NO: 66890 - DNA, 22 bp, Artificial Sequence
  chemically synthesized
aagcccctgacagcaagagccc

SEQ ID NO: 66891 - DNA, 22 bp, Artificial Sequence
  chemically synthesized
acagcaagagcccagaactggg

SEQ ID NO: 66892 - DNA, 22 bp, Artificial Sequence
  chemically synthesized
ggacaccattagtgacccagac

SEQ ID NO: 66893 - DNA, 22 bp, Artificial Sequence
  chemically synthesized
gtgacccagacggcaggtaagc

SEQ ID NO: 66894 - DNA, 22 bp, Artificial Sequence
  chemically synthesized
actgcaggagcatcagcctatt

SEQ ID NO: 66895 - DNA, 22 bp, Artificial Sequence
  chemically synthesized
caggagcatcagcctattcttg

SEQ ID NO: 66896 - DNA, 22 bp, Artificial Sequence
  chemically synthesized
ttcttgtgtctgggaccacaga

SEQ ID NO: 66897 - DNA, 22 bp, Artificial Sequence
  chemically synthesized
ttgtgtctgggaccacagagca

SEQ ID NO: 66898 - DNA, 22 bp, Artificial Sequence
  chemically synthesized
gtgtctgggaccacagagcatt

SEQ ID NO: 66899 - DNA, 22 bp, Artificial Sequence
  chemically synthesized
tgtctgggaccacagagcattg

SEQ ID NO: 66900 - DNA, 22 bp, Artificial Sequence
  chemically synthesized
ggaccacagagcattgtgggga

SEQ ID NO: 66901 - DNA, 22 bp, Artificial Sequence
  chemically synthesized
tggggacagccccgtctcttgg

SEQ ID NO: 66902 - DNA, 22 bp, Artificial Sequence
  chemically synthesized
ttgggaaaaaaaccctaagggc

SEQ ID NO: 66903 - DNA, 22 bp, Artificial Sequence
  chemically synthesized
gggaaaaaaaccctaagggctg

SEQ ID NO: 66904 - DNA, 22 bp, Artificial Sequence
  chemically synthesized
ggaaaaaaaccctaagggctga

SEQ ID NO: 66905 - DNA, 22 bp, Artificial Sequence
  chemically synthesized
agggctgaggatccttgtgagt

SEQ ID NO: 66906 - DNA, 22 bp, Artificial Sequence
  chemically synthesized
aggatccttgtgagtgttgggt

SEQ ID NO: 66907 - DNA, 22 bp, Artificial Sequence
  chemically synthesized
gtgagtgttgggtgggaacagc

SEQ ID NO: 66908 - DNA, 22 bp, Artificial Sequence
  chemically synthesized
tgagtgttgggtgggaacagct

SEQ ID NO: 66909 - DNA, 22 bp, Artificial Sequence
  chemically synthesized
ggtgggaacagctcccaggagg

SEQ ID NO: 66910 - DNA, 22 bp, Artificial Sequence
  chemically synthesized
ccaggaggtttaatcacagccc

SEQ ID NO: 66911 - DNA, 22 bp, Artificial Sequence
  chemically synthesized
aatcacagcccctccatgctct

SEQ ID NO: 66912 - DNA, 22 bp, Artificial Sequence
  chemically synthesized
atcacagcccctccatgctctc

SEQ ID NO: 66913 - DNA, 22 bp, Artificial Sequence
  chemically synthesized
catgctctctagctgttgccat

SEQ ID NO: 66914 - DNA, 22 bp, Artificial Sequence
  chemically synthesized
tctagctgttgccattgtgcaa

SEQ ID NO: 66915 - DNA, 22 bp, Artificial Sequence
  chemically synthesized
tagctgttgccattgtgcaaga

SEQ ID NO: 66916 - DNA, 22 bp, Artificial Sequence
  chemically synthesized
gctgttgccattgtgcaagatg

SEQ ID NO: 66917 - DNA, 22 bp, Artificial Sequence
  chemically synthesized
ttgccattgtgcaagatgcatt

SEQ ID NO: 66918 - DNA, 22 bp, Artificial Sequence
  chemically synthesized
ccattgtgcaagatgcatttcc

SEQ ID NO: 66919 - DNA, 22 bp, Artificial Sequence
  chemically synthesized
tgcaagatgcatttcccttctg

SEQ ID NO: 66920 - DNA, 22 bp, Artificial Sequence
  chemically synthesized
cccttctgtgcagcagtttccc

SEQ ID NO: 66921 - DNA, 22 bp, Artificial Sequence
  chemically synthesized
ccttctgtgcagcagtttccct

SEQ ID NO: 66922 - DNA, 22 bp, Artificial Sequence
  chemically synthesized
ctgtgcagcagtttccctggcc

SEQ ID NO: 66923 - DNA, 22 bp, Artificial Sequence
  chemically synthesized
tgtgcagcagtttccctggcca

SEQ ID NO: 66924 - DNA, 22 bp, Artificial Sequence
  chemically synthesized
tgcagcagtttccctggccact

SEQ ID NO: 66925 - DNA, 22 bp, Artificial Sequence
  chemically synthesized
ccctggccactaaatagtggga

SEQ ID NO: 66926 - DNA, 22 bp, Artificial Sequence
  chemically synthesized
cctggccactaaatagtgggat

SEQ ID NO: 66927 - DNA, 22 bp, Artificial Sequence
  chemically synthesized
gccactaaatagtgggattaga

SEQ ID NO: 66928 - DNA, 22 bp, Artificial Sequence
  chemically synthesized
aatagtgggattagatagaagc

SEQ ID NO: 66929 - DNA, 22 bp, Artificial Sequence
  chemically synthesized
gatagaagccctccaagggctt

SEQ ID NO: 66930 - DNA, 22 bp, Artificial Sequence
  chemically synthesized
caagggcttccagcttgacatg

SEQ ID NO: 66931 - DNA, 22 bp, Artificial Sequence
  chemically synthesized
ccagcttgacatgattcttgat

SEQ ID NO: 66932 - DNA, 22 bp, Artificial Sequence
  chemically synthesized
cagcttgacatgattcttgatt

SEQ ID NO: 66933 - DNA, 22 bp, Artificial Sequence
  chemically synthesized
gacatgattcttgattctgatc

SEQ ID NO: 66934 - DNA, 22 bp, Artificial Sequence
  chemically synthesized
acatgattcttgattctgatct

SEQ ID NO: 66935 - DNA, 22 bp, Artificial Sequence
  chemically synthesized
ttgattctgatctggcccgatt

SEQ ID NO: 66936 - DNA, 22 bp, Artificial Sequence
  chemically synthesized
gattctgatctggcccgattcc

SEQ ID NO: 66937 - DNA, 22 bp, Artificial Sequence
  chemically synthesized
attctgatctggcccgattcct

SEQ ID NO: 66938 - DNA, 22 bp, Artificial Sequence
  chemically synthesized
tgatctggcccgattcctggat

SEQ ID NO: 66939 - DNA, 22 bp, Artificial Sequence
  chemically synthesized
atctggcccgattcctggataa

SEQ ID NO: 66940 - DNA, 22 bp, Artificial Sequence
  chemically synthesized
gcccgattcctggataatcgtg

SEQ ID NO: 66941 - DNA, 22 bp, Artificial Sequence
  chemically synthesized
ctggataatcgtgggcaggccc

SEQ ID NO: 66942 - DNA, 22 bp, Artificial Sequence
  chemically synthesized
gataatcgtgggcaggcccatt

SEQ ID NO: 66943 - DNA, 22 bp, Artificial Sequence
  chemically synthesized
ctcttcttgtgcctcattttct

SEQ ID NO: 66944 - DNA, 22 bp, Artificial Sequence
  chemically synthesized
ttcttgtgcctcattttcttct

SEQ ID NO: 66945 - DNA, 22 bp, Artificial Sequence
  chemically synthesized
cttgtgcctcattttcttcttt

SEQ ID NO: 66946 - DNA, 22 bp, Artificial Sequence
  chemically synthesized
ttgtgcctcattttcttctttt

SEQ ID NO: 66947 - DNA, 22 bp, Artificial Sequence
  chemically synthesized
gtgcctcattttcttcttttgt

SEQ ID NO: 66948 - DNA, 22 bp, Artificial Sequence
  chemically synthesized
tgcctcattttcttcttttgta

SEQ ID NO: 66949 - DNA, 22 bp, Artificial Sequence
  chemically synthesized
attttcttcttttgtaaaacaa

SEQ ID NO: 66950 - DNA, 22 bp, Artificial Sequence
  chemically synthesized
tcttcttttgtaaaacaatggc

SEQ ID NO: 66951 - DNA, 22 bp, Artificial Sequence
  chemically synthesized
cttcttttgtaaaacaatggct

SEQ ID NO: 66952 - DNA, 22 bp, Artificial Sequence
  chemically synthesized
ttcttttgtaaaacaatggctg

SEQ ID NO: 66953 - DNA, 22 bp, Artificial Sequence
  chemically synthesized
cttttgtaaaacaatggctgta

SEQ ID NO: 66954 - DNA, 22 bp, Artificial Sequence
  chemically synthesized
ttttgtaaaacaatggctgtac

SEQ ID NO: 66955 - DNA, 22 bp, Artificial Sequence
  chemically synthesized
ttgtaaaacaatggctgtacca

SEQ ID NO: 66956 - DNA, 22 bp, Artificial Sequence
  chemically synthesized
tgtaaaacaatggctgtaccat

SEQ ID NO: 66957 - DNA, 22 bp, Artificial Sequence
  chemically synthesized
gtaaaacaatggctgtaccatt

SEQ ID NO: 66958 - DNA, 22 bp, Artificial Sequence
  chemically synthesized
taaaacaatggctgtaccattt

SEQ ID NO: 66959 - DNA, 22 bp, Artificial Sequence
  chemically synthesized
taccatttgcatcttagggtca

SEQ ID NO: 66960 - DNA, 22 bp, Artificial Sequence
  chemically synthesized
gcatcttagggtcattgcagat

SEQ ID NO: 66961 - DNA, 22 bp, Artificial Sequence
  chemically synthesized
catcttagggtcattgcagatg

SEQ ID NO: 66962 - DNA, 22 bp, Artificial Sequence
  chemically synthesized
agggtcattgcagatgtaagtg

SEQ ID NO: 66963 - DNA, 22 bp, Artificial Sequence
  chemically synthesized
gggtcattgcagatgtaagtgt

SEQ ID NO: 66964 - DNA, 22 bp, Artificial Sequence
  chemically synthesized
cagatgtaagtgttgctgtcca

SEQ ID NO: 66965 - DNA, 22 bp, Artificial Sequence
  chemically synthesized
ctgtccagagcctgggtgcagg

SEQ ID NO: 66966 - DNA, 22 bp, Artificial Sequence
  chemically synthesized
tccagagcctgggtgcaggacc

SEQ ID NO: 66967 - DNA, 22 bp, Artificial Sequence
  chemically synthesized
ggtgcaggacctagatgtagga

SEQ ID NO: 66968 - DNA, 22 bp, Artificial Sequence
  chemically synthesized
gatgtaggattctggttctgct

SEQ ID NO: 66969 - DNA, 22 bp, Artificial Sequence
  chemically synthesized
tggttctgctacttcctcagtg

SEQ ID NO: 66970 - DNA, 22 bp, Artificial Sequence
  chemically synthesized
gttctgctacttcctcagtgac

SEQ ID NO: 66971 - DNA, 22 bp, Artificial Sequence
  chemically synthesized
tgctacttcctcagtgacattg

SEQ ID NO: 66972 - DNA, 22 bp, Artificial Sequence
  chemically synthesized
ctacttcctcagtgacattgaa

SEQ ID NO: 66973 - DNA, 22 bp, Artificial Sequence
  chemically synthesized
cttcctcagtgacattgaatag

SEQ ID NO: 66974 - DNA, 22 bp, Artificial Sequence
  chemically synthesized
cctcagtgacattgaatagctg

SEQ ID NO: 66975 - DNA, 22 bp, Artificial Sequence
  chemically synthesized
ctcagtgacattgaatagctga

SEQ ID NO: 66976 - DNA, 22 bp, Artificial Sequence
  chemically synthesized
agtgacattgaatagctgacct

SEQ ID NO: 66977 - DNA, 22 bp, Artificial Sequence
  chemically synthesized
aatagctgacctaatctctctg

SEQ ID NO: 66978 - DNA, 22 bp, Artificial Sequence
  chemically synthesized
acctaatctctctggctttggt

SEQ ID NO: 66979 - DNA, 22 bp, Artificial Sequence
  chemically synthesized
atctctctggctttggtttctt

SEQ ID NO: 66980 - DNA, 22 bp, Artificial Sequence
  chemically synthesized
tctggctttggtttcttcatct

SEQ ID NO: 66981 - DNA, 22 bp, Artificial Sequence
  chemically synthesized
tggctttggtttcttcatctgt

SEQ ID NO: 66982 - DNA, 22 bp, Artificial Sequence
  chemically synthesized
gctttggtttcttcatctgtaa

SEQ ID NO: 66983 - DNA, 22 bp, Artificial Sequence
  chemically synthesized
tggtttcttcatctgtaaaaga

SEQ ID NO: 66984 - DNA, 22 bp, Artificial Sequence
  chemically synthesized
ggtttcttcatctgtaaaagaa

SEQ ID NO: 66985 - DNA, 22 bp, Artificial Sequence
  chemically synthesized
gtttcttcatctgtaaaagaag

SEQ ID NO: 66986 - DNA, 22 bp, Artificial Sequence
  chemically synthesized
cttcatctgtaaaagaaggata

SEQ ID NO: 66987 - DNA, 22 bp, Artificial Sequence
  chemically synthesized
ttcatctgtaaaagaaggatat

SEQ ID NO: 66988 - DNA, 22 bp, Artificial Sequence
  chemically synthesized
catctgtaaaagaaggatatta

SEQ ID NO: 66989 - DNA, 22 bp, Artificial Sequence
  chemically synthesized
atctgtaaaagaaggatattag

SEQ ID NO: 66990 - DNA, 22 bp, Artificial Sequence
  chemically synthesized
taaaagaaggatattagcatta

SEQ ID NO: 66991 - DNA, 22 bp, Artificial Sequence
  chemically synthesized
gcattagcacctcacgggattg

SEQ ID NO: 66992 - DNA, 22 bp, Artificial Sequence
  chemically synthesized
gcacctcacgggattgttacaa

SEQ ID NO: 66993 - DNA, 22 bp, Artificial Sequence
  chemically synthesized
acgggattgttacaagaaagca

SEQ ID NO: 66994 - DNA, 22 bp, Artificial Sequence
  chemically synthesized
ttacaagaaagcaatgaattaa

SEQ ID NO: 66995 - DNA, 22 bp, Artificial Sequence
  chemically synthesized
caagaaagcaatgaattaacac

SEQ ID NO: 66996 - DNA, 22 bp, Artificial Sequence
  chemically synthesized
acacatgtgagcacggagaaca

SEQ ID NO: 66997 - DNA, 22 bp, Artificial Sequence
  chemically synthesized
ggcatatggtaagcactacgta

SEQ ID NO: 66998 - DNA, 22 bp, Artificial Sequence
  chemically synthesized
gcatatggtaagcactacgtac

SEQ ID NO: 66999 - DNA, 22 bp, Artificial Sequence
  chemically synthesized
cgtacattttgctattcttctg

SEQ ID NO: 67000 - DNA, 22 bp, Artificial Sequence
  chemically synthesized
tgctattcttctgattctttca

SEQ ID NO: 67001 - DNA, 22 bp, Artificial Sequence
  chemically synthesized
gctattcttctgattctttcag

SEQ ID NO: 67002 - DNA, 22 bp, Artificial Sequence
  chemically synthesized
ctattcttctgattctttcagt

SEQ ID NO: 67003 - DNA, 22 bp, Artificial Sequence
  chemically synthesized
ttcttctgattctttcagtgtt

SEQ ID NO: 67004 - DNA, 22 bp, Artificial Sequence
  chemically synthesized
ttctgattctttcagtgttact

SEQ ID NO: 67005 - DNA, 22 bp, Artificial Sequence
  chemically synthesized
ctgattctttcagtgttactga

SEQ ID NO: 67006 - DNA, 22 bp, Artificial Sequence
  chemically synthesized
tgattctttcagtgttactgat

SEQ ID NO: 67007 - DNA, 22 bp, Artificial Sequence
  chemically synthesized
attctttcagtgttactgatgt

SEQ ID NO: 67008 - DNA, 22 bp, Artificial Sequence
  chemically synthesized
tttcagtgttactgatgtcggc

SEQ ID NO: 67009 - DNA, 22 bp, Artificial Sequence
  chemically synthesized
tcagtgttactgatgtcggcaa

SEQ ID NO: 67010 - DNA, 22 bp, Artificial Sequence
  chemically synthesized
cagtgttactgatgtcggcaag

SEQ ID NO: 67011 - DNA, 22 bp, Artificial Sequence
  chemically synthesized
agtgttactgatgtcggcaagt

SEQ ID NO: 67012 - DNA, 22 bp, Artificial Sequence
  chemically synthesized
ctgatgtcggcaagtacttggc

SEQ ID NO: 67013 - DNA, 22 bp, Artificial Sequence
  chemically synthesized
atgtcggcaagtacttggcaca

SEQ ID NO: 67014 - DNA, 22 bp, Artificial Sequence
  chemically synthesized
ggcacaggctggtttaataatc

SEQ ID NO: 67015 - DNA, 22 bp, Artificial Sequence
  chemically synthesized
gcacaggctggtttaataatcc

SEQ ID NO: 67016 - DNA, 22 bp, Artificial Sequence
  chemically synthesized
gtttaataatccctaggcactt

SEQ ID NO: 67017 - DNA, 22 bp, Artificial Sequence
  chemically synthesized
aataatccctaggcacttccac

SEQ ID NO: 67018 - DNA, 22 bp, Artificial Sequence
  chemically synthesized
ataatccctaggcacttccacg

SEQ ID NO: 67019 - DNA, 22 bp, Artificial Sequence
  chemically synthesized
ggcacttccacgtggtgtcaat

SEQ ID NO: 67020 - DNA, 22 bp, Artificial Sequence
  chemically synthesized
ccacgtggtgtcaatccctgat

SEQ ID NO: 67021 - DNA, 22 bp, Artificial Sequence
  chemically synthesized
cacgtggtgtcaatccctgatc

SEQ ID NO: 67022 - DNA, 22 bp, Artificial Sequence
  chemically synthesized
atcactgggagtcatcatgtgc

SEQ ID NO: 67023 - DNA, 22 bp, Artificial Sequence
  chemically synthesized
ggagtcatcatgtgccttgact

SEQ ID NO: 67024 - DNA, 22 bp, Artificial Sequence
  chemically synthesized
gactcggggcctggccccccca

SEQ ID NO: 67025 - DNA, 22 bp, Artificial Sequence
  chemically synthesized
actcggggcctggcccccccat

SEQ ID NO: 67026 - DNA, 22 bp, Artificial Sequence
  chemically synthesized
ggggcctggcccccccatctct

SEQ ID NO: 67027 - DNA, 22 bp, Artificial Sequence
  chemically synthesized
gcccccccatctctgtcttgca

SEQ ID NO: 67028 - DNA, 22 bp, Artificial Sequence
  chemically synthesized
tgtcttgcaggacaatgccgtc

SEQ ID NO: 67029 - DNA, 22 bp, Artificial Sequence
  chemically synthesized
tcttgcaggacaatgccgtctt

SEQ ID NO: 67030 - DNA, 22 bp, Artificial Sequence
  chemically synthesized
gcaggacaatgccgtcttctgt

SEQ ID NO: 67031 - DNA, 22 bp, Artificial Sequence
  chemically synthesized
caggacaatgccgtcttctgtc

SEQ ID NO: 67032 - DNA, 22 bp, Artificial Sequence
  chemically synthesized
ctgtctcgtggggcatcctcct

SEQ ID NO: 67033 - DNA, 22 bp, Artificial Sequence
  chemically synthesized
tgtctcgtggggcatcctcctg

SEQ ID NO: 67034 - DNA, 22 bp, Artificial Sequence
  chemically synthesized
tctcgtggggcatcctcctgct

SEQ ID NO: 67035 - DNA, 22 bp, Artificial Sequence
  chemically synthesized
gtggggcatcctcctgctggca

SEQ ID NO: 67036 - DNA, 22 bp, Artificial Sequence
  chemically synthesized
ctgctggcaggcctgtgctgcc

SEQ ID NO: 67037 - DNA, 22 bp, Artificial Sequence
  chemically synthesized
ctggcaggcctgtgctgcctgg

SEQ ID NO: 67038 - DNA, 22 bp, Artificial Sequence
  chemically synthesized
gcaggcctgtgctgcctggtcc

SEQ ID NO: 67039 - DNA, 22 bp, Artificial Sequence
  chemically synthesized
tgctgcctggtccctgtctccc

SEQ ID NO: 67040 - DNA, 22 bp, Artificial Sequence
  chemically synthesized
cctggtccctgtctccctggct

SEQ ID NO: 67041 - DNA, 22 bp, Artificial Sequence
  chemically synthesized
gtccctgtctccctggctgagg

SEQ ID NO: 67042 - DNA, 22 bp, Artificial Sequence
  chemically synthesized
tctccctggctgaggatcccca

SEQ ID NO: 67043 - DNA, 22 bp, Artificial Sequence
  chemically synthesized
cctggctgaggatccccaggga

SEQ ID NO: 67044 - DNA, 22 bp, Artificial Sequence
  chemically synthesized
gctgaggatccccagggagatg

SEQ ID NO: 67045 - DNA, 22 bp, Artificial Sequence
  chemically synthesized
aggatccccagggagatgctgc

SEQ ID NO: 67046 - DNA, 22 bp, Artificial Sequence
  chemically synthesized
cccagaagacagatacatccca

SEQ ID NO: 67047 - DNA, 22 bp, Artificial Sequence
  chemically synthesized
caacaagatcacccccaacctg

SEQ ID NO: 67048 - DNA, 22 bp, Artificial Sequence
  chemically synthesized
aacaagatcacccccaacctgg

SEQ ID NO: 67049 - DNA, 22 bp, Artificial Sequence
  chemically synthesized
gctgagttcgccttcagcctat

SEQ ID NO: 67050 - DNA, 22 bp, Artificial Sequence
  chemically synthesized
agttcgccttcagcctataccg

SEQ ID NO: 67051 - DNA, 22 bp, Artificial Sequence
  chemically synthesized
gccttcagcctataccgccagc

SEQ ID NO: 67052 - DNA, 22 bp, Artificial Sequence
  chemically synthesized
cagcctataccgccagctggca

SEQ ID NO: 67053 - DNA, 22 bp, Artificial Sequence
  chemically synthesized
agcctataccgccagctggcac

SEQ ID NO: 67054 - DNA, 22 bp, Artificial Sequence
  chemically synthesized
taccgccagctggcacaccagt

SEQ ID NO: 67055 - DNA, 22 bp, Artificial Sequence
  chemically synthesized
gcacaccagtccaacagcacca

SEQ ID NO: 67056 - DNA, 22 bp, Artificial Sequence
  chemically synthesized
cttctccccagtgagcatcgct

SEQ ID NO: 67057 - DNA, 22 bp, Artificial Sequence
  chemically synthesized
ttctccccagtgagcatcgcta

SEQ ID NO: 67058 - DNA, 22 bp, Artificial Sequence
  chemically synthesized
ctccccagtgagcatcgctaca

SEQ ID NO: 67059 - DNA, 22 bp, Artificial Sequence
  chemically synthesized
tccccagtgagcatcgctacag

SEQ ID NO: 67060 - DNA, 22 bp, Artificial Sequence
  chemically synthesized
cccagtgagcatcgctacagcc

SEQ ID NO: 67061 - DNA, 22 bp, Artificial Sequence
  chemically synthesized
cagcctttgcaatgctctccct

SEQ ID NO: 67062 - DNA, 22 bp, Artificial Sequence
  chemically synthesized
tgcaatgctctccctggggacc

SEQ ID NO: 67063 - DNA, 22 bp, Artificial Sequence
  chemically synthesized
gcaatgctctccctggggacca

SEQ ID NO: 67064 - DNA, 22 bp, Artificial Sequence
  chemically synthesized
caatgctctccctggggaccaa

SEQ ID NO: 67065 - DNA, 22 bp, Artificial Sequence
  chemically synthesized
tccctggggaccaaggctgaca

SEQ ID NO: 67066 - DNA, 22 bp, Artificial Sequence
  chemically synthesized
cctggggaccaaggctgacact

SEQ ID NO: 67067 - DNA, 22 bp, Artificial Sequence
  chemically synthesized
gggaccaaggctgacactcacg

SEQ ID NO: 67068 - DNA, 22 bp, Artificial Sequence
  chemically synthesized
acactcacgatgaaatcctgga

SEQ ID NO: 67069 - DNA, 22 bp, Artificial Sequence
  chemically synthesized
acgatgaaatcctggagggcct

SEQ ID NO: 67070 - DNA, 22 bp, Artificial Sequence
  chemically synthesized
gagggcctgaatttcaacctca

SEQ ID NO: 67071 - DNA, 22 bp, Artificial Sequence
  chemically synthesized
aatttcaacctcacggagattc

SEQ ID NO: 67072 - DNA, 22 bp, Artificial Sequence
  chemically synthesized
caacctcacggagattccggag

SEQ ID NO: 67073 - DNA, 22 bp, Artificial Sequence
  chemically synthesized
aacctcacggagattccggagg

SEQ ID NO: 67074 - DNA, 22 bp, Artificial Sequence
  chemically synthesized
acggagattccggaggctcaga

SEQ ID NO: 67075 - DNA, 22 bp, Artificial Sequence
  chemically synthesized
cggaggctcagatccatgaagg

SEQ ID NO: 67076 - DNA, 22 bp, Artificial Sequence
  chemically synthesized
agatccatgaaggcttccagga

SEQ ID NO: 67077 - DNA, 22 bp, Artificial Sequence
  chemically synthesized
ccaggaactcctccgtaccctc

SEQ ID NO: 67078 - DNA, 22 bp, Artificial Sequence
  chemically synthesized
caggaactcctccgtaccctca

SEQ ID NO: 67079 - DNA, 22 bp, Artificial Sequence
  chemically synthesized
ctccgtaccctcaaccagccag

SEQ ID NO: 67080 - DNA, 22 bp, Artificial Sequence
  chemically synthesized
cgtaccctcaaccagccagaca

SEQ ID NO: 67081 - DNA, 22 bp, Artificial Sequence
  chemically synthesized
aaccagccagacagccagctcc

SEQ ID NO: 67082 - DNA, 22 bp, Artificial Sequence
  chemically synthesized
cagctgaccaccggcaatggcc

SEQ ID NO: 67083 - DNA, 22 bp, Artificial Sequence
  chemically synthesized
accaccggcaatggcctgttcc

SEQ ID NO: 67084 - DNA, 22 bp, Artificial Sequence
  chemically synthesized
ttcctcagcgagggcctgaagc

SEQ ID NO: 67085 - DNA, 22 bp, Artificial Sequence
  chemically synthesized
ctcagcgagggcctgaagctag

SEQ ID NO: 67086 - DNA, 22 bp, Artificial Sequence
  chemically synthesized
agcgagggcctgaagctagtgg

SEQ ID NO: 67087 - DNA, 22 bp, Artificial Sequence
  chemically synthesized
aagctagtggataagtttttgg

SEQ ID NO: 67088 - DNA, 22 bp, Artificial Sequence
  chemically synthesized
gtggataagtttttggaggatg

SEQ ID NO: 67089 - DNA, 22 bp, Artificial Sequence
  chemically synthesized
ttggaggatgttaaaaagttgt

SEQ ID NO: 67090 - DNA, 22 bp, Artificial Sequence
  chemically synthesized
tggaggatgttaaaaagttgta

SEQ ID NO: 67091 - DNA, 22 bp, Artificial Sequence
  chemically synthesized
ggaggatgttaaaaagttgtac

SEQ ID NO: 67092 - DNA, 22 bp, Artificial Sequence
  chemically synthesized
gaggatgttaaaaagttgtacc

SEQ ID NO: 67093 - DNA, 22 bp, Artificial Sequence
  chemically synthesized
aaaagttgtaccactcagaagc

SEQ ID NO: 67094 - DNA, 22 bp, Artificial Sequence
  chemically synthesized
taccactcagaagccttcactg

SEQ ID NO: 67095 - DNA, 22 bp, Artificial Sequence
  chemically synthesized
agaagccttcactgtcaacttc

SEQ ID NO: 67096 - DNA, 22 bp, Artificial Sequence
  chemically synthesized
cactgtcaacttcggggacacc

SEQ ID NO: 67097 - DNA, 22 bp, Artificial Sequence
  chemically synthesized
actgtcaacttcggggacaccg

SEQ ID NO: 67098 - DNA, 22 bp, Artificial Sequence
  chemically synthesized
tcaacttcggggacaccgaaga

SEQ ID NO: 67099 - DNA, 22 bp, Artificial Sequence
  chemically synthesized
cggggacaccgaagaggccaag

SEQ ID NO: 67100 - DNA, 22 bp, Artificial Sequence
  chemically synthesized
ggggacaccgaagaggccaaga

SEQ ID NO: 67101 - DNA, 22 bp, Artificial Sequence
  chemically synthesized
cgtggagaagggtactcaaggg

SEQ ID NO: 67102 - DNA, 22 bp, Artificial Sequence
  chemically synthesized
aagggaaaattgtggatttggt

SEQ ID NO: 67103 - DNA, 22 bp, Artificial Sequence
  chemically synthesized
tggatttggtcaaggagcttga

SEQ ID NO: 67104 - DNA, 22 bp, Artificial Sequence
  chemically synthesized
ggtcaaggagcttgacagagac

SEQ ID NO: 67105 - DNA, 22 bp, Artificial Sequence
  chemically synthesized
gtcaaggagcttgacagagaca

SEQ ID NO: 67106 - DNA, 22 bp, Artificial Sequence
  chemically synthesized
gacagagacacagtttttgctc

SEQ ID NO: 67107 - DNA, 22 bp, Artificial Sequence
  chemically synthesized
acagagacacagtttttgctct

SEQ ID NO: 67108 - DNA, 22 bp, Artificial Sequence
  chemically synthesized
ttgctctggtgaattacatctt

SEQ ID NO: 67109 - DNA, 22 bp, Artificial Sequence
  chemically synthesized
tgctctggtgaattacatcttc

SEQ ID NO: 67110 - DNA, 22 bp, Artificial Sequence
  chemically synthesized
gctctggtgaattacatcttct

SEQ ID NO: 67111 - DNA, 22 bp, Artificial Sequence
  chemically synthesized
ctctggtgaattacatcttctt

SEQ ID NO: 67112 - DNA, 22 bp, Artificial Sequence
  chemically synthesized
tggtgaattacatcttctttaa

SEQ ID NO: 67113 - DNA, 22 bp, Artificial Sequence
  chemically synthesized
gtgaattacatcttctttaaag

SEQ ID NO: 67114 - DNA, 22 bp, Artificial Sequence
  chemically synthesized
catcttctttaaaggtaaggtt

SEQ ID NO: 67115 - DNA, 22 bp, Artificial Sequence
  chemically synthesized
ctttaaaggtaaggttgctcaa

SEQ ID NO: 67116 - DNA, 22 bp, Artificial Sequence
  chemically synthesized
tttaaaggtaaggttgctcaac

SEQ ID NO: 67117 - DNA, 22 bp, Artificial Sequence
  chemically synthesized
taaaggtaaggttgctcaacca

SEQ ID NO: 67118 - DNA, 22 bp, Artificial Sequence
  chemically synthesized
aaaggtaaggttgctcaaccag

SEQ ID NO: 67119 - DNA, 22 bp, Artificial Sequence
  chemically synthesized
aaggtaaggttgctcaaccagc

SEQ ID NO: 67120 - DNA, 22 bp, Artificial Sequence
  chemically synthesized
ctcaaccagcctgagctgttcc

SEQ ID NO: 67121 - DNA, 22 bp, Artificial Sequence
  chemically synthesized
aaccagcctgagctgttcccat

SEQ ID NO: 67122 - DNA, 22 bp, Artificial Sequence
  chemically synthesized
agctgttcccatagaaacaagc

SEQ ID NO: 67123 - DNA, 22 bp, Artificial Sequence
  chemically synthesized
ttcccatagaaacaagcaaaaa

SEQ ID NO: 67124 - DNA, 22 bp, Artificial Sequence
  chemically synthesized
ccatagaaacaagcaaaaatat

SEQ ID NO: 67125 - DNA, 22 bp, Artificial Sequence
  chemically synthesized
tcaaaccatcagttcttgaact

SEQ ID NO: 67126 - DNA, 22 bp, Artificial Sequence
  chemically synthesized
aaaccatcagttcttgaactct

SEQ ID NO: 67127 - DNA, 22 bp, Artificial Sequence
  chemically synthesized
ttgaactctccttggcaatgca

SEQ ID NO: 67128 - DNA, 22 bp, Artificial Sequence
  chemically synthesized
gaactctccttggcaatgcatt

SEQ ID NO: 67129 - DNA, 22 bp, Artificial Sequence
  chemically synthesized
aactctccttggcaatgcatta

SEQ ID NO: 67130 - DNA, 22 bp, Artificial Sequence
  chemically synthesized
tccttggcaatgcattatgggc

SEQ ID NO: 67131 - DNA, 22 bp, Artificial Sequence
  chemically synthesized
cttggcaatgcattatgggcca

SEQ ID NO: 67132 - DNA, 22 bp, Artificial Sequence
  chemically synthesized
ggcaatgcattatgggccatag

SEQ ID NO: 67133 - DNA, 22 bp, Artificial Sequence
  chemically synthesized
gcaatgcattatgggccatagc

SEQ ID NO: 67134 - DNA, 22 bp, Artificial Sequence
  chemically synthesized
tgggccatagcaatgcttttca

SEQ ID NO: 67135 - DNA, 22 bp, Artificial Sequence
  chemically synthesized
ttcagcgtggattcttcagttt

SEQ ID NO: 67136 - DNA, 22 bp, Artificial Sequence
  chemically synthesized
tcagcgtggattcttcagtttt

SEQ ID NO: 67137 - DNA, 22 bp, Artificial Sequence
  chemically synthesized
cagcgtggattcttcagttttc

SEQ ID NO: 67138 - DNA, 22 bp, Artificial Sequence
  chemically synthesized
agcgtggattcttcagttttct

SEQ ID NO: 67139 - DNA, 22 bp, Artificial Sequence
  chemically synthesized
ttcagttttctacacacaaaca

SEQ ID NO: 67140 - DNA, 22 bp, Artificial Sequence
  chemically synthesized
cagttttctacacacaaacact

SEQ ID NO: 67141 - DNA, 22 bp, Artificial Sequence
  chemically synthesized
agttttctacacacaaacacta

SEQ ID NO: 67142 - DNA, 22 bp, Artificial Sequence
  chemically synthesized
tctacacacaaacactaaaatg

SEQ ID NO: 67143 - DNA, 22 bp, Artificial Sequence
  chemically synthesized
ctacacacaaacactaaaatgt

SEQ ID NO: 67144 - DNA, 22 bp, Artificial Sequence
  chemically synthesized
tacacacaaacactaaaatgtt

SEQ ID NO: 67145 - DNA, 22 bp, Artificial Sequence
  chemically synthesized
cacacaaacactaaaatgtttt

SEQ ID NO: 67146 - DNA, 22 bp, Artificial Sequence
  chemically synthesized
aaatgttttccatcattgagta

SEQ ID NO: 67147 - DNA, 22 bp, Artificial Sequence
  chemically synthesized
tccatcattgagtaatttgagg

SEQ ID NO: 67148 - DNA, 22 bp, Artificial Sequence
  chemically synthesized
ccatcattgagtaatttgagga

SEQ ID NO: 67149 - DNA, 22 bp, Artificial Sequence
  chemically synthesized
catcattgagtaatttgaggaa

SEQ ID NO: 67150 - DNA, 22 bp, Artificial Sequence
  chemically synthesized
agtaatttgaggaaataataga

SEQ ID NO: 67151 - DNA, 22 bp, Artificial Sequence
  chemically synthesized
gaggaaataatagattaaactg

SEQ ID NO: 67152 - DNA, 22 bp, Artificial Sequence
  chemically synthesized
aggaaataatagattaaactgt

SEQ ID NO: 67153 - DNA, 22 bp, Artificial Sequence
  chemically synthesized
aactgtcaaaactactgacagc

SEQ ID NO: 67154 - DNA, 22 bp, Artificial Sequence
  chemically synthesized
tcaaaactactgacagctctgc

SEQ ID NO: 67155 - DNA, 22 bp, Artificial Sequence
  chemically synthesized
ctgacagctctgcagaactttt

SEQ ID NO: 67156 - DNA, 22 bp, Artificial Sequence
  chemically synthesized
acagctctgcagaacttttcag

SEQ ID NO: 67157 - DNA, 22 bp, Artificial Sequence
  chemically synthesized
tgcagaacttttcagagccttt

SEQ ID NO: 67158 - DNA, 22 bp, Artificial Sequence
  chemically synthesized
cagaacttttcagagcctttaa

SEQ ID NO: 67159 - DNA, 22 bp, Artificial Sequence
  chemically synthesized
ttcagagcctttaatgtccttg

SEQ ID NO: 67160 - DNA, 22 bp, Artificial Sequence
  chemically synthesized
tcagagcctttaatgtccttgt

SEQ ID NO: 67161 - DNA, 22 bp, Artificial Sequence
  chemically synthesized
cagagcctttaatgtccttgtg

SEQ ID NO: 67162 - DNA, 22 bp, Artificial Sequence
  chemically synthesized
agagcctttaatgtccttgtgt

SEQ ID NO: 67163 - DNA, 22 bp, Artificial Sequence
  chemically synthesized
taatgtccttgtgtatactgta

SEQ ID NO: 67164 - DNA, 22 bp, Artificial Sequence
  chemically synthesized
aatgtccttgtgtatactgtat

SEQ ID NO: 67165 - DNA, 22 bp, Artificial Sequence
  chemically synthesized
atgtccttgtgtatactgtata

SEQ ID NO: 67166 - DNA, 22 bp, Artificial Sequence
  chemically synthesized
gtgtatactgtatatgtagaat

SEQ ID NO: 67167 - DNA, 22 bp, Artificial Sequence
  chemically synthesized
tgtatactgtatatgtagaata

SEQ ID NO: 67168 - DNA, 22 bp, Artificial Sequence
  chemically synthesized
tatatgtagaatatataatgct

SEQ ID NO: 67169 - DNA, 22 bp, Artificial Sequence
  chemically synthesized
agaactatagaacaaattgtaa

SEQ ID NO: 67170 - DNA, 22 bp, Artificial Sequence
  chemically synthesized
gaactatagaacaaattgtaat

SEQ ID NO: 67171 - DNA, 22 bp, Artificial Sequence
  chemically synthesized
tagaacaaattgtaatacactg

SEQ ID NO: 67172 - DNA, 22 bp, Artificial Sequence
  chemically synthesized
taatacactgcataaagggata

SEQ ID NO: 67173 - DNA, 22 bp, Artificial Sequence
  chemically synthesized
cataaagggatagtttcatgga

SEQ ID NO: 67174 - DNA, 22 bp, Artificial Sequence
  chemically synthesized
catggaacatactttacacgac

SEQ ID NO: 67175 - DNA, 22 bp, Artificial Sequence
  chemically synthesized
atggaacatactttacacgact

SEQ ID NO: 67176 - DNA, 22 bp, Artificial Sequence
  chemically synthesized
tacacgactctagtgtcccaga

SEQ ID NO: 67177 - DNA, 22 bp, Artificial Sequence
  chemically synthesized
acacgactctagtgtcccagaa

SEQ ID NO: 67178 - DNA, 22 bp, Artificial Sequence
  chemically synthesized
cacgactctagtgtcccagaat

SEQ ID NO: 67179 - DNA, 22 bp, Artificial Sequence
  chemically synthesized
tagtgtcccagaatcagtatca

SEQ ID NO: 67180 - DNA, 22 bp, Artificial Sequence
  chemically synthesized
gtgtcccagaatcagtatcagt

SEQ ID NO: 67181 - DNA, 22 bp, Artificial Sequence
  chemically synthesized
tgcaatctgaaagacctgggtt

SEQ ID NO: 67182 - DNA, 22 bp, Artificial Sequence
  chemically synthesized
gcaatctgaaagacctgggttc

SEQ ID NO: 67183 - DNA, 22 bp, Artificial Sequence
  chemically synthesized
caatctgaaagacctgggttca

SEQ ID NO: 67184 - DNA, 22 bp, Artificial Sequence
  chemically synthesized
aaagacctgggttcaaatcctg

SEQ ID NO: 67185 - DNA, 22 bp, Artificial Sequence
  chemically synthesized
ggttcaaatcctgcctctaaca

SEQ ID NO: 67186 - DNA, 22 bp, Artificial Sequence
  chemically synthesized
aaatcctgcctctaacacaatt

SEQ ID NO: 67187 - DNA, 22 bp, Artificial Sequence
  chemically synthesized
cctctaacacaattagcttttg

SEQ ID NO: 67188 - DNA, 22 bp, Artificial Sequence
  chemically synthesized
taacacaattagcttttgacaa

SEQ ID NO: 67189 - DNA, 22 bp, Artificial Sequence
  chemically synthesized
acacaattagcttttgacaaaa

SEQ ID NO: 67190 - DNA, 22 bp, Artificial Sequence
  chemically synthesized
gcttttgacaaaaacaatgcat

SEQ ID NO: 67191 - DNA, 22 bp, Artificial Sequence
  chemically synthesized
ttgacaaaaacaatgcattcta

SEQ ID NO: 67192 - DNA, 22 bp, Artificial Sequence
  chemically synthesized
tgacaaaaacaatgcattctac

SEQ ID NO: 67193 - DNA, 22 bp, Artificial Sequence
  chemically synthesized
gacaaaaacaatgcattctacc

SEQ ID NO: 67194 - DNA, 22 bp, Artificial Sequence
  chemically synthesized
acaaaaacaatgcattctacct

SEQ ID NO: 67195 - DNA, 22 bp, Artificial Sequence
  chemically synthesized
tacctctttgaggtgctaattt

SEQ ID NO: 67196 - DNA, 22 bp, Artificial Sequence
  chemically synthesized
cctctttgaggtgctaatttct

SEQ ID NO: 67197 - DNA, 22 bp, Artificial Sequence
  chemically synthesized
tttgaggtgctaatttctcatc

SEQ ID NO: 67198 - DNA, 22 bp, Artificial Sequence
  chemically synthesized
tgaggtgctaatttctcatctt

SEQ ID NO: 67199 - DNA, 22 bp, Artificial Sequence
  chemically synthesized
gaggtgctaatttctcatctta

SEQ ID NO: 67200 - DNA, 22 bp, Artificial Sequence
  chemically synthesized
aggtgctaatttctcatcttag

SEQ ID NO: 67201 - DNA, 22 bp, Artificial Sequence
  chemically synthesized
atttctcatcttagcatggaca

SEQ ID NO: 67202 - DNA, 22 bp, Artificial Sequence
  chemically synthesized
ctcatcttagcatggacaaaat

SEQ ID NO: 67203 - DNA, 22 bp, Artificial Sequence
  chemically synthesized
tcatcttagcatggacaaaata

SEQ ID NO: 67204 - DNA, 22 bp, Artificial Sequence
  chemically synthesized
atcttagcatggacaaaatacc

SEQ ID NO: 67205 - DNA, 22 bp, Artificial Sequence
  chemically synthesized
agcatggacaaaataccattct

SEQ ID NO: 67206 - DNA, 22 bp, Artificial Sequence
  chemically synthesized
gcatggacaaaataccattctt

SEQ ID NO: 67207 - DNA, 22 bp, Artificial Sequence
  chemically synthesized
ttgctgtcaggtttttttagga

SEQ ID NO: 67208 - DNA, 22 bp, Artificial Sequence
  chemically synthesized
gctgtcaggtttttttaggatt

SEQ ID NO: 67209 - DNA, 22 bp, Artificial Sequence
  chemically synthesized
ctgtcaggtttttttaggatta

SEQ ID NO: 67210 - DNA, 22 bp, Artificial Sequence
  chemically synthesized
tcaggtttttttaggattaaac

SEQ ID NO: 67211 - DNA, 22 bp, Artificial Sequence
  chemically synthesized
ttttaggattaaacaaatgaca

SEQ ID NO: 67212 - DNA, 22 bp, Artificial Sequence
  chemically synthesized
tttaggattaaacaaatgacaa

SEQ ID NO: 67213 - DNA, 22 bp, Artificial Sequence
  chemically synthesized
ttaggattaaacaaatgacaaa

SEQ ID NO: 67214 - DNA, 22 bp, Artificial Sequence
  chemically synthesized
taggattaaacaaatgacaaag

SEQ ID NO: 67215 - DNA, 22 bp, Artificial Sequence
  chemically synthesized
aggattaaacaaatgacaaaga

SEQ ID NO: 67216 - DNA, 22 bp, Artificial Sequence
  chemically synthesized
ggattaaacaaatgacaaagac

SEQ ID NO: 67217 - DNA, 22 bp, Artificial Sequence
  chemically synthesized
aacaaatgacaaagactgtggg

SEQ ID NO: 67218 - DNA, 22 bp, Artificial Sequence
  chemically synthesized
tggggatggtgtgtggcataca

SEQ ID NO: 67219 - DNA, 22 bp, Artificial Sequence
  chemically synthesized
ttctgtatctcaggctgccttc

SEQ ID NO: 67220 - DNA, 22 bp, Artificial Sequence
  chemically synthesized
ctgtatctcaggctgccttcct

SEQ ID NO: 67221 - DNA, 22 bp, Artificial Sequence
  chemically synthesized
tgtatctcaggctgccttcctg

SEQ ID NO: 67222 - DNA, 22 bp, Artificial Sequence
  chemically synthesized
tatctcaggctgccttcctgcc

SEQ ID NO: 67223 - DNA, 22 bp, Artificial Sequence
  chemically synthesized
aggctgccttcctgcccctgag

SEQ ID NO: 67224 - DNA, 22 bp, Artificial Sequence
  chemically synthesized
ccttcctgcccctgaggggtta

SEQ ID NO: 67225 - DNA, 22 bp, Artificial Sequence
  chemically synthesized
cctgcccctgaggggttaaaat

SEQ ID NO: 67226 - DNA, 22 bp, Artificial Sequence
  chemically synthesized
ctgcccctgaggggttaaaatg

SEQ ID NO: 67227 - DNA, 22 bp, Artificial Sequence
  chemically synthesized
cccctgaggggttaaaatgcca

SEQ ID NO: 67228 - DNA, 22 bp, Artificial Sequence
  chemically synthesized
aggggttaaaatgccagggtcc

SEQ ID NO: 67229 - DNA, 22 bp, Artificial Sequence
  chemically synthesized
aaatgccagggtcctgggggcc

SEQ ID NO: 67230 - DNA, 22 bp, Artificial Sequence
  chemically synthesized
ggggccccagggcattctaagc

SEQ ID NO: 67231 - DNA, 22 bp, Artificial Sequence
  chemically synthesized
taagccagctcccactgtccca

SEQ ID NO: 67232 - DNA, 22 bp, Artificial Sequence
  chemically synthesized
agccagctcccactgtcccagg

SEQ ID NO: 67233 - DNA, 22 bp, Artificial Sequence
  chemically synthesized
ccactgtcccaggaaaacagca

SEQ ID NO: 67234 - DNA, 22 bp, Artificial Sequence
  chemically synthesized
tcccaggaaaacagcatagggg

SEQ ID NO: 67235 - DNA, 22 bp, Artificial Sequence
  chemically synthesized
cttcctccactctgaggctccc

SEQ ID NO: 67236 - DNA, 22 bp, Artificial Sequence
  chemically synthesized
cctccactctgaggctcccttg

SEQ ID NO: 67237 - DNA, 22 bp, Artificial Sequence
  chemically synthesized
ctccactctgaggctcccttgc

SEQ ID NO: 67238 - DNA, 22 bp, Artificial Sequence
  chemically synthesized
cactctgaggctcccttgctct

SEQ ID NO: 67239 - DNA, 22 bp, Artificial Sequence
  chemically synthesized
tgaggctcccttgctcttgagg

SEQ ID NO: 67240 - DNA, 22 bp, Artificial Sequence
  chemically synthesized
aggctcccttgctcttgaggca

SEQ ID NO: 67241 - DNA, 22 bp, Artificial Sequence
  chemically synthesized
ccttgctcttgaggcaaaggag

SEQ ID NO: 67242 - DNA, 22 bp, Artificial Sequence
  chemically synthesized
gctcttgaggcaaaggagggca

SEQ ID NO: 67243 - DNA, 22 bp, Artificial Sequence
  chemically synthesized
ctcttgaggcaaaggagggcag

SEQ ID NO: 67244 - DNA, 22 bp, Artificial Sequence
  chemically synthesized
ttgaggcaaaggagggcagtgg

SEQ ID NO: 67245 - DNA, 22 bp, Artificial Sequence
  chemically synthesized
gaggcaaaggagggcagtggag

SEQ ID NO: 67246 - DNA, 22 bp, Artificial Sequence
  chemically synthesized
aggcaaaggagggcagtggaga

SEQ ID NO: 67247 - DNA, 22 bp, Artificial Sequence
  chemically synthesized
cagtcagcacagctaaagtcct

SEQ ID NO: 67248 - DNA, 22 bp, Artificial Sequence
  chemically synthesized
aagtcctggctctgctgtggcc

SEQ ID NO: 67249 - DNA, 22 bp, Artificial Sequence
  chemically synthesized
gctctgctgtggccttagtggg

SEQ ID NO: 67250 - DNA, 22 bp, Artificial Sequence
  chemically synthesized
tgctgtggccttagtgggggcc

SEQ ID NO: 67251 - DNA, 22 bp, Artificial Sequence
  chemically synthesized
ctgtggccttagtgggggccca

SEQ ID NO: 67252 - DNA, 22 bp, Artificial Sequence
  chemically synthesized
tggccttagtgggggcccaggt

SEQ ID NO: 67253 - DNA, 22 bp, Artificial Sequence
  chemically synthesized
agtgggggcccaggtccctctc

SEQ ID NO: 67254 - DNA, 22 bp, Artificial Sequence
  chemically synthesized
gtgggggcccaggtccctctcc

SEQ ID NO: 67255 - DNA, 22 bp, Artificial Sequence
  chemically synthesized
tccagccccagtctcctccttc

SEQ ID NO: 67256 - DNA, 22 bp, Artificial Sequence
  chemically synthesized
cagccccagtctcctccttctg

SEQ ID NO: 67257 - DNA, 22 bp, Artificial Sequence
  chemically synthesized
ctccttctgtccaatgagaaag

SEQ ID NO: 67258 - DNA, 22 bp, Artificial Sequence
  chemically synthesized
cttctgtccaatgagaaagctg

SEQ ID NO: 67259 - DNA, 22 bp, Artificial Sequence
  chemically synthesized
ctgtccaatgagaaagctggga

SEQ ID NO: 67260 - DNA, 22 bp, Artificial Sequence
  chemically synthesized
tgtccaatgagaaagctgggat

SEQ ID NO: 67261 - DNA, 22 bp, Artificial Sequence
  chemically synthesized
tccaatgagaaagctgggatca

SEQ ID NO: 67262 - DNA, 22 bp, Artificial Sequence
  chemically synthesized
ggatcaggggtccctgaggccc

SEQ ID NO: 67263 - DNA, 22 bp, Artificial Sequence
  chemically synthesized
aggcccctgtccactctgcatg

SEQ ID NO: 67264 - DNA, 22 bp, Artificial Sequence
  chemically synthesized
tccactctgcatgcctcgatgg

SEQ ID NO: 67265 - DNA, 22 bp, Artificial Sequence
  chemically synthesized
tgcatgcctcgatggtgaagct

SEQ ID NO: 67266 - DNA, 22 bp, Artificial Sequence
  chemically synthesized
catgcctcgatggtgaagctct

SEQ ID NO: 67267 - DNA, 22 bp, Artificial Sequence
  chemically synthesized
gatggtgaagctctgttggtat

SEQ ID NO: 67268 - DNA, 22 bp, Artificial Sequence
  chemically synthesized
tgttggtatggcagaggggagg

SEQ ID NO: 67269 - DNA, 22 bp, Artificial Sequence
  chemically synthesized
ttggtatggcagaggggaggct

SEQ ID NO: 67270 - DNA, 22 bp, Artificial Sequence
  chemically synthesized
gtatggcagaggggaggctgct

SEQ ID NO: 67271 - DNA, 22 bp, Artificial Sequence
  chemically synthesized
ctcaggcatctgcatttcccct

SEQ ID NO: 67272 - DNA, 22 bp, Artificial Sequence
  chemically synthesized
aggcatctgcatttcccctgcc

SEQ ID NO: 67273 - DNA, 22 bp, Artificial Sequence
  chemically synthesized
catttcccctgccaatctagag

SEQ ID NO: 67274 - DNA, 22 bp, Artificial Sequence
  chemically synthesized
cccctgccaatctagaggatga

SEQ ID NO: 67275 - DNA, 22 bp, Artificial Sequence
  chemically synthesized
ccctgccaatctagaggatgag

SEQ ID NO: 67276 - DNA, 22 bp, Artificial Sequence
  chemically synthesized
ccaatctagaggatgaggaaag

SEQ ID NO: 67277 - DNA, 22 bp, Artificial Sequence
  chemically synthesized
gaggatgaggaaagctctcagg

SEQ ID NO: 67278 - DNA, 22 bp, Artificial Sequence
  chemically synthesized
tcaggaatagtaagcagaatgt

SEQ ID NO: 67279 - DNA, 22 bp, Artificial Sequence
  chemically synthesized
aggaatagtaagcagaatgttt

SEQ ID NO: 67280 - DNA, 22 bp, Artificial Sequence
  chemically synthesized
gccctggatgaataactgagct

SEQ ID NO: 67281 - DNA, 22 bp, Artificial Sequence
  chemically synthesized
ccctggatgaataactgagctg

SEQ ID NO: 67282 - DNA, 22 bp, Artificial Sequence
  chemically synthesized
gatgaataactgagctgccaat

SEQ ID NO: 67283 - DNA, 22 bp, Artificial Sequence
  chemically synthesized
agctgccaattaacaaggggca

SEQ ID NO: 67284 - DNA, 22 bp, Artificial Sequence
  chemically synthesized
ccaattaacaaggggcagggag

SEQ ID NO: 67285 - DNA, 22 bp, Artificial Sequence
  chemically synthesized
acaaggggcagggagccttaga

SEQ ID NO: 67286 - DNA, 22 bp, Artificial Sequence
  chemically synthesized
agacagaaggtaccaaatatgc

SEQ ID NO: 67287 - DNA, 22 bp, Artificial Sequence
  chemically synthesized
gacagaaggtaccaaatatgcc

SEQ ID NO: 67288 - DNA, 22 bp, Artificial Sequence
  chemically synthesized
atgctccaacattttatttgta

SEQ ID NO: 67289 - DNA, 22 bp, Artificial Sequence
  chemically synthesized
caacattttatttgtaatatcc

SEQ ID NO: 67290 - DNA, 22 bp, Artificial Sequence
  chemically synthesized
tatttgtaatatccaagacacc

SEQ ID NO: 67291 - DNA, 22 bp, Artificial Sequence
  chemically synthesized
atttgtaatatccaagacaccc

SEQ ID NO: 67292 - DNA, 22 bp, Artificial Sequence
  chemically synthesized
tttgtaatatccaagacaccct

SEQ ID NO: 67293 - DNA, 22 bp, Artificial Sequence
  chemically synthesized
gtaatatccaagacaccctcaa

SEQ ID NO: 67294 - DNA, 22 bp, Artificial Sequence
  chemically synthesized
taatatccaagacaccctcaaa

SEQ ID NO: 67295 - DNA, 22 bp, Artificial Sequence
  chemically synthesized
aaataaacatatgattccaata

SEQ ID NO: 67296 - DNA, 22 bp, Artificial Sequence
  chemically synthesized
caataaaaatgcacagccacga

SEQ ID NO: 67297 - DNA, 22 bp, Artificial Sequence
  chemically synthesized
ttagcctgacatcgccacgatg

SEQ ID NO: 67298 - DNA, 22 bp, Artificial Sequence
  chemically synthesized
agcctgacatcgccacgatgta

SEQ ID NO: 67299 - DNA, 22 bp, Artificial Sequence
  chemically synthesized
gcctgacatcgccacgatgtag

SEQ ID NO: 67300 - DNA, 22 bp, Artificial Sequence
  chemically synthesized
acatcgccacgatgtagaaatt

SEQ ID NO: 67301 - DNA, 22 bp, Artificial Sequence
  chemically synthesized
tgcatcttcctctagttttgaa

SEQ ID NO: 67302 - DNA, 22 bp, Artificial Sequence
  chemically synthesized
catcttcctctagttttgaatt

SEQ ID NO: 67303 - DNA, 22 bp, Artificial Sequence
  chemically synthesized
cctctagttttgaattatcccc

SEQ ID NO: 67304 - DNA, 22 bp, Artificial Sequence
  chemically synthesized
ctctagttttgaattatcccca

SEQ ID NO: 67305 - DNA, 22 bp, Artificial Sequence
  chemically synthesized
tagttttgaattatccccacac

SEQ ID NO: 67306 - DNA, 22 bp, Artificial Sequence
  chemically synthesized
gttttgaattatccccacacaa

SEQ ID NO: 67307 - DNA, 22 bp, Artificial Sequence
  chemically synthesized
tgaattatccccacacaatctt

SEQ ID NO: 67308 - DNA, 22 bp, Artificial Sequence
  chemically synthesized
gaattatccccacacaatcttt

SEQ ID NO: 67309 - DNA, 22 bp, Artificial Sequence
  chemically synthesized
aattatccccacacaatctttt

SEQ ID NO: 67310 - DNA, 22 bp, Artificial Sequence
  chemically synthesized
tccccacacaatctttttcggc

SEQ ID NO: 67311 - DNA, 22 bp, Artificial Sequence
  chemically synthesized
tttcggcagcttggatggtcag

SEQ ID NO: 67312 - DNA, 22 bp, Artificial Sequence
  chemically synthesized
ttcggcagcttggatggtcagt

SEQ ID NO: 67313 - DNA, 22 bp, Artificial Sequence
  chemically synthesized
tcggcagcttggatggtcagtt

SEQ ID NO: 67314 - DNA, 22 bp, Artificial Sequence
  chemically synthesized
cggcagcttggatggtcagttt

SEQ ID NO: 67315 - DNA, 22 bp, Artificial Sequence
  chemically synthesized
ggcagcttggatggtcagtttc

SEQ ID NO: 67316 - DNA, 22 bp, Artificial Sequence
  chemically synthesized
ggatggtcagtttcagcacctt

SEQ ID NO: 67317 - DNA, 22 bp, Artificial Sequence
  chemically synthesized
gatggtcagtttcagcaccttt

SEQ ID NO: 67318 - DNA, 22 bp, Artificial Sequence
  chemically synthesized
cagcaccttttacagatgatga

SEQ ID NO: 67319 - DNA, 22 bp, Artificial Sequence
  chemically synthesized
agcaccttttacagatgatgaa

SEQ ID NO: 67320 - DNA, 22 bp, Artificial Sequence
  chemically synthesized
ttacagatgatgaagctgagcc

SEQ ID NO: 67321 - DNA, 22 bp, Artificial Sequence
  chemically synthesized
tacagatgatgaagctgagcct

SEQ ID NO: 67322 - DNA, 22 bp, Artificial Sequence
  chemically synthesized
acagatgatgaagctgagcctc

SEQ ID NO: 67323 - DNA, 22 bp, Artificial Sequence
  chemically synthesized
cagatgatgaagctgagcctcg

SEQ ID NO: 67324 - DNA, 22 bp, Artificial Sequence
  chemically synthesized
agcctcgagggatgtgtgtcgt

SEQ ID NO: 67325 - DNA, 22 bp, Artificial Sequence
  chemically synthesized
gagggatgtgtgtcgtcaaggg

SEQ ID NO: 67326 - DNA, 22 bp, Artificial Sequence
  chemically synthesized
agggcttctcagggaggggact

SEQ ID NO: 67327 - DNA, 22 bp, Artificial Sequence
  chemically synthesized
ctcagggaggggactcatggtt

SEQ ID NO: 67328 - DNA, 22 bp, Artificial Sequence
  chemically synthesized
tcagggaggggactcatggttt

SEQ ID NO: 67329 - DNA, 22 bp, Artificial Sequence
  chemically synthesized
agggaggggactcatggtttct

SEQ ID NO: 67330 - DNA, 22 bp, Artificial Sequence
  chemically synthesized
atggtttctttattctgctaca

SEQ ID NO: 67331 - DNA, 22 bp, Artificial Sequence
  chemically synthesized
ctttattctgctacactcttcc

SEQ ID NO: 67332 - DNA, 22 bp, Artificial Sequence
  chemically synthesized
tttattctgctacactcttcca

SEQ ID NO: 67333 - DNA, 22 bp, Artificial Sequence
  chemically synthesized
tattctgctacactcttccaaa

SEQ ID NO: 67334 - DNA, 22 bp, Artificial Sequence
  chemically synthesized
attctgctacactcttccaaac

SEQ ID NO: 67335 - DNA, 22 bp, Artificial Sequence
  chemically synthesized
ttctgctacactcttccaaacc

SEQ ID NO: 67336 - DNA, 22 bp, Artificial Sequence
  chemically synthesized
tgctacactcttccaaaccttc

SEQ ID NO: 67337 - DNA, 22 bp, Artificial Sequence
  chemically synthesized
ctacactcttccaaaccttcac

SEQ ID NO: 67338 - DNA, 22 bp, Artificial Sequence
  chemically synthesized
cactcttccaaaccttcactca

SEQ ID NO: 67339 - DNA, 22 bp, Artificial Sequence
  chemically synthesized
ttccaaaccttcactcacccct

SEQ ID NO: 67340 - DNA, 22 bp, Artificial Sequence
  chemically synthesized
ccaaaccttcactcacccctgg

SEQ ID NO: 67341 - DNA, 22 bp, Artificial Sequence
  chemically synthesized
caaaccttcactcacccctggt

SEQ ID NO: 67342 - DNA, 22 bp, Artificial Sequence
  chemically synthesized
cactcacccctggtgatgccca

SEQ ID NO: 67343 - DNA, 22 bp, Artificial Sequence
  chemically synthesized
actcacccctggtgatgcccac

SEQ ID NO: 67344 - DNA, 22 bp, Artificial Sequence
  chemically synthesized
acccctggtgatgcccaccttc

SEQ ID NO: 67345 - DNA, 22 bp, Artificial Sequence
  chemically synthesized
gtgatgcccaccttcccctctc

SEQ ID NO: 67346 - DNA, 22 bp, Artificial Sequence
  chemically synthesized
cccctctctccaggcaaatggg

SEQ ID NO: 67347 - DNA, 22 bp, Artificial Sequence
  chemically synthesized
ccctctctccaggcaaatggga

SEQ ID NO: 67348 - DNA, 22 bp, Artificial Sequence
  chemically synthesized
tctccaggcaaatgggagagac

SEQ ID NO: 67349 - DNA, 22 bp, Artificial Sequence
  chemically synthesized
tccaggcaaatgggagagaccc

SEQ ID NO: 67350 - DNA, 22 bp, Artificial Sequence
  chemically synthesized
caggcaaatgggagagaccctt

SEQ ID NO: 67351 - DNA, 22 bp, Artificial Sequence
  chemically synthesized
tgaagtcaaggacaccgaggaa

SEQ ID NO: 67352 - DNA, 22 bp, Artificial Sequence
  chemically synthesized
gaagtcaaggacaccgaggaag

SEQ ID NO: 67353 - DNA, 22 bp, Artificial Sequence
  chemically synthesized
aagtcaaggacaccgaggaaga

SEQ ID NO: 67354 - DNA, 22 bp, Artificial Sequence
  chemically synthesized
ccacgtggaccaggtgaccacc

SEQ ID NO: 67355 - DNA, 22 bp, Artificial Sequence
  chemically synthesized
cacgtggaccaggtgaccaccg

SEQ ID NO: 67356 - DNA, 22 bp, Artificial Sequence
  chemically synthesized
tgatgaagcgtttaggcatgtt

SEQ ID NO: 67357 - DNA, 22 bp, Artificial Sequence
  chemically synthesized
aggcatgtttaacatccagcac

SEQ ID NO: 67358 - DNA, 22 bp, Artificial Sequence
  chemically synthesized
ggcatgtttaacatccagcact

SEQ ID NO: 67359 - DNA, 22 bp, Artificial Sequence
  chemically synthesized
aacatccagcactgtaagaagc

SEQ ID NO: 67360 - DNA, 22 bp, Artificial Sequence
  chemically synthesized
acatccagcactgtaagaagct

SEQ ID NO: 67361 - DNA, 22 bp, Artificial Sequence
  chemically synthesized
taagaagctgtccagctgggtg

SEQ ID NO: 67362 - DNA, 22 bp, Artificial Sequence
  chemically synthesized
tccagctgggtgctgctgatga

SEQ ID NO: 67363 - DNA, 22 bp, Artificial Sequence
  chemically synthesized
ggtgctgctgatgaaatacctg

SEQ ID NO: 67364 - DNA, 22 bp, Artificial Sequence
  chemically synthesized
ctgatgaaatacctgggcaatg

SEQ ID NO: 67365 - DNA, 22 bp, Artificial Sequence
  chemically synthesized
atgaaatacctgggcaatgcca

SEQ ID NO: 67366 - DNA, 22 bp, Artificial Sequence
  chemically synthesized
ggcaatgccaccgccatcttct

SEQ ID NO: 67367 - DNA, 22 bp, Artificial Sequence
  chemically synthesized
cttcctgcctgatgaggggaaa

SEQ ID NO: 67368 - DNA, 22 bp, Artificial Sequence
  chemically synthesized
ttcctgcctgatgaggggaaac

SEQ ID NO: 67369 - DNA, 22 bp, Artificial Sequence
  chemically synthesized
cctgcctgatgaggggaaacta

SEQ ID NO: 67370 - DNA, 22 bp, Artificial Sequence
  chemically synthesized
ctgcctgatgaggggaaactac

SEQ ID NO: 67371 - DNA, 22 bp, Artificial Sequence
  chemically synthesized
cctgatgaggggaaactacagc

SEQ ID NO: 67372 - DNA, 22 bp, Artificial Sequence
  chemically synthesized
atgaggggaaactacagcacct

SEQ ID NO: 67373 - DNA, 22 bp, Artificial Sequence
  chemically synthesized
cagcacctggaaaatgaactca

SEQ ID NO: 67374 - DNA, 22 bp, Artificial Sequence
  chemically synthesized
gaaaatgaactcacccacgata

SEQ ID NO: 67375 - DNA, 22 bp, Artificial Sequence
  chemically synthesized
acccacgatatcatcaccaagt

SEQ ID NO: 67376 - DNA, 22 bp, Artificial Sequence
  chemically synthesized
ctggaaaatgaagacagaaggt

SEQ ID NO: 67377 - DNA, 22 bp, Artificial Sequence
  chemically synthesized
gaaaatgaagacagaaggtgat

SEQ ID NO: 67378 - DNA, 22 bp, Artificial Sequence
  chemically synthesized
cccaacctgagggtgaccaaga

SEQ ID NO: 67379 - DNA, 22 bp, Artificial Sequence
  chemically synthesized
agggtgaccaagaagctgccca

SEQ ID NO: 67380 - DNA, 22 bp, Artificial Sequence
  chemically synthesized
cccacacctcttagccatgttg

SEQ ID NO: 67381 - DNA, 22 bp, Artificial Sequence
  chemically synthesized
ttagccatgttgggactgaggc

SEQ ID NO: 67382 - DNA, 22 bp, Artificial Sequence
  chemically synthesized
agccatgttgggactgaggccc

SEQ ID NO: 67383 - DNA, 22 bp, Artificial Sequence
  chemically synthesized
gccatgttgggactgaggccca

SEQ ID NO: 67384 - DNA, 22 bp, Artificial Sequence
  chemically synthesized
ggactgaggcccatcaggactg

SEQ ID NO: 67385 - DNA, 22 bp, Artificial Sequence
  chemically synthesized
aggcccatcaggactggccaga

SEQ ID NO: 67386 - DNA, 22 bp, Artificial Sequence
  chemically synthesized
gccagagggctgaggagggtga

SEQ ID NO: 67387 - DNA, 22 bp, Artificial Sequence
  chemically synthesized
aggagggtgaaccccacatccc

SEQ ID NO: 67388 - DNA, 22 bp, Artificial Sequence
  chemically synthesized
ggtcactgctactctgtataaa

SEQ ID NO: 67389 - DNA, 22 bp, Artificial Sequence
  chemically synthesized
ctactctgtataaacttggctt

SEQ ID NO: 67390 - DNA, 22 bp, Artificial Sequence
  chemically synthesized
ctctgtataaacttggcttcca

SEQ ID NO: 67391 - DNA, 22 bp, Artificial Sequence
  chemically synthesized
tgtataaacttggcttccagaa

SEQ ID NO: 67392 - DNA, 22 bp, Artificial Sequence
  chemically synthesized
tataaacttggcttccagaatg

SEQ ID NO: 67393 - DNA, 22 bp, Artificial Sequence
  chemically synthesized
ggcttccagaatgaggccacca

SEQ ID NO: 67394 - DNA, 22 bp, Artificial Sequence
  chemically synthesized
gcttccagaatgaggccaccac

SEQ ID NO: 67395 - DNA, 22 bp, Artificial Sequence
  chemically synthesized
ccagaatgaggccaccactgag

SEQ ID NO: 67396 - DNA, 22 bp, Artificial Sequence
  chemically synthesized
cagaatgaggccaccactgagt

SEQ ID NO: 67397 - DNA, 22 bp, Artificial Sequence
  chemically synthesized
agttcaggcagcgccatccatg

SEQ ID NO: 67398 - DNA, 22 bp, Artificial Sequence
  chemically synthesized
aggcagcgccatccatgctcca

SEQ ID NO: 67399 - DNA, 22 bp, Artificial Sequence
  chemically synthesized
catgaggaggacagtacccagg

SEQ ID NO: 67400 - DNA, 22 bp, Artificial Sequence
  chemically synthesized
gtccctggggacttcccactcc

SEQ ID NO: 67401 - DNA, 22 bp, Artificial Sequence
  chemically synthesized
gggacttcccactccagtgtgg

SEQ ID NO: 67402 - DNA, 22 bp, Artificial Sequence
  chemically synthesized
cccactccagtgtggacactgt

SEQ ID NO: 67403 - DNA, 22 bp, Artificial Sequence
  chemically synthesized
ccactccagtgtggacactgtc

SEQ ID NO: 67404 - DNA, 22 bp, Artificial Sequence
  chemically synthesized
cagtgtggacactgtcccttcc

SEQ ID NO: 67405 - DNA, 22 bp, Artificial Sequence
  chemically synthesized
tcccttcccaatatccagtgcc

SEQ ID NO: 67406 - DNA, 22 bp, Artificial Sequence
  chemically synthesized
cccaatatccagtgcccagggc

SEQ ID NO: 67407 - DNA, 22 bp, Artificial Sequence
  chemically synthesized
ccaatatccagtgcccagggca

SEQ ID NO: 67408 - DNA, 22 bp, Artificial Sequence
  chemically synthesized
tggcagaaccaaaaaggaacag

SEQ ID NO: 67409 - DNA, 22 bp, Artificial Sequence
  chemically synthesized
gcagaaccaaaaaggaacagat

SEQ ID NO: 67410 - DNA, 22 bp, Artificial Sequence
  chemically synthesized
cctggcaaaggcagcagtggag

SEQ ID NO: 67411 - DNA, 22 bp, Artificial Sequence
  chemically synthesized
ctggcaaaggcagcagtggagt

SEQ ID NO: 67412 - DNA, 22 bp, Artificial Sequence
  chemically synthesized
gcaaaggcagcagtggagtgtg

SEQ ID NO: 67413 - DNA, 22 bp, Artificial Sequence
  chemically synthesized
aagggtagaatgtccctggggg

SEQ ID NO: 67414 - DNA, 22 bp, Artificial Sequence
  chemically synthesized
gggggacgggggaagagcctgt

SEQ ID NO: 67415 - DNA, 22 bp, Artificial Sequence
  chemically synthesized
tgtggcaaggcccagaaaagca

SEQ ID NO: 67416 - DNA, 22 bp, Artificial Sequence
  chemically synthesized
ggaattggaacagccaggccat

SEQ ID NO: 67417 - DNA, 22 bp, Artificial Sequence
  chemically synthesized
gaacagccaggccatgttcgca

SEQ ID NO: 67418 - DNA, 22 bp, Artificial Sequence
  chemically synthesized
gcagaaggcttgcgtttctctg

SEQ ID NO: 67419 - DNA, 22 bp, Artificial Sequence
  chemically synthesized
gcgtttctctgtcactttatcg

SEQ ID NO: 67420 - DNA, 22 bp, Artificial Sequence
  chemically synthesized
cgtttctctgtcactttatcgg

SEQ ID NO: 67421 - DNA, 22 bp, Artificial Sequence
  chemically synthesized
ctctgtcactttatcggtgctg

SEQ ID NO: 67422 - DNA, 22 bp, Artificial Sequence
  chemically synthesized
tctgtcactttatcggtgctgt

SEQ ID NO: 67423 - DNA, 22 bp, Artificial Sequence
  chemically synthesized
tgtcactttatcggtgctgtta

SEQ ID NO: 67424 - DNA, 22 bp, Artificial Sequence
  chemically synthesized
tcactttatcggtgctgttaga

SEQ ID NO: 67425 - DNA, 22 bp, Artificial Sequence
  chemically synthesized
tatcggtgctgttagattgggt

SEQ ID NO: 67426 - DNA, 22 bp, Artificial Sequence
  chemically synthesized
atcggtgctgttagattgggtg

SEQ ID NO: 67427 - DNA, 22 bp, Artificial Sequence
  chemically synthesized
tcggtgctgttagattgggtgt

SEQ ID NO: 67428 - DNA, 22 bp, Artificial Sequence
  chemically synthesized
ttagattgggtgtcctgtagta

SEQ ID NO: 67429 - DNA, 22 bp, Artificial Sequence
  chemically synthesized
gattgggtgtcctgtagtaagt

SEQ ID NO: 67430 - DNA, 22 bp, Artificial Sequence
  chemically synthesized
ggtgtcctgtagtaagtgatac

SEQ ID NO: 67431 - DNA, 22 bp, Artificial Sequence
  chemically synthesized
tagtaagtgatacttaaacatg

SEQ ID NO: 67432 - DNA, 22 bp, Artificial Sequence
  chemically synthesized
aaacatgagccacacattagtg

SEQ ID NO: 67433 - DNA, 22 bp, Artificial Sequence
  chemically synthesized
aacatgagccacacattagtgt

SEQ ID NO: 67434 - DNA, 22 bp, Artificial Sequence
  chemically synthesized
gtgtatgtgtgtgcattcgtga

SEQ ID NO: 67435 - DNA, 22 bp, Artificial Sequence
  chemically synthesized
gtgattatgcccatgccctgct

SEQ ID NO: 67436 - DNA, 22 bp, Artificial Sequence
  chemically synthesized
tgcccatgccctgctgatctag

SEQ ID NO: 67437 - DNA, 22 bp, Artificial Sequence
  chemically synthesized
ctgatctagttcgttttgtaca

SEQ ID NO: 67438 - DNA, 22 bp, Artificial Sequence
  chemically synthesized
atctagttcgttttgtacactg

SEQ ID NO: 67439 - DNA, 22 bp, Artificial Sequence
  chemically synthesized
gttcgttttgtacactgtaaaa

SEQ ID NO: 67440 - DNA, 22 bp, Artificial Sequence
  chemically synthesized
gttttgtacactgtaaaaccaa

SEQ ID NO: 67441 - DNA, 22 bp, Artificial Sequence
  chemically synthesized
tgtacactgtaaaaccaagatg

SEQ ID NO: 67442 - DNA, 22 bp, Artificial Sequence
  chemically synthesized
gtacactgtaaaaccaagatga

SEQ ID NO: 67443 - DNA, 22 bp, Artificial Sequence
  chemically synthesized
tacactgtaaaaccaagatgaa

SEQ ID NO: 67444 - DNA, 22 bp, Artificial Sequence
  chemically synthesized
taaaaccaagatgaaaatacaa

SEQ ID NO: 67445 - DNA, 22 bp, Artificial Sequence
  chemically synthesized
ataataggaatcgaggctggaa

SEQ ID NO: 67446 - DNA, 22 bp, Artificial Sequence
  chemically synthesized
gaatttctctgttccatgccag

SEQ ID NO: 67447 - DNA, 22 bp, Artificial Sequence
  chemically synthesized
ctctgttccatgccagcacctc

SEQ ID NO: 67448 - DNA, 22 bp, Artificial Sequence
  chemically synthesized
tctgttccatgccagcacctcc

SEQ ID NO: 67449 - DNA, 22 bp, Artificial Sequence
  chemically synthesized
tgttccatgccagcacctcctg

SEQ ID NO: 67450 - DNA, 22 bp, Artificial Sequence
  chemically synthesized
ttccatgccagcacctcctgag

SEQ ID NO: 67451 - DNA, 22 bp, Artificial Sequence
  chemically synthesized
catgccagcacctcctgaggtc

SEQ ID NO: 67452 - DNA, 22 bp, Artificial Sequence
  chemically synthesized
ctgaggtctctgctccaggggt

SEQ ID NO: 67453 - DNA, 22 bp, Artificial Sequence
  chemically synthesized
aggtctctgctccaggggttga

SEQ ID NO: 67454 - DNA, 22 bp, Artificial Sequence
  chemically synthesized
tgctccaggggttgagaaagaa

SEQ ID NO: 67455 - DNA, 22 bp, Artificial Sequence
  chemically synthesized
ctccaggggttgagaaagaaca

SEQ ID NO: 67456 - DNA, 22 bp, Artificial Sequence
  chemically synthesized
caggggttgagaaagaacaaag

SEQ ID NO: 67457 - DNA, 22 bp, Artificial Sequence
  chemically synthesized
agaaagaacaaagaggctgaga

SEQ ID NO: 67458 - DNA, 22 bp, Artificial Sequence
  chemically synthesized
agagggtaacggatcagagagc

SEQ ID NO: 67459 - DNA, 22 bp, Artificial Sequence
  chemically synthesized
cccgctcacaccagaccctgct

SEQ ID NO: 67460 - DNA, 22 bp, Artificial Sequence
  chemically synthesized
acaccagaccctgctcagggtg

SEQ ID NO: 67461 - DNA, 22 bp, Artificial Sequence
  chemically synthesized
ctcagggtggcattgtctcccc

SEQ ID NO: 67462 - DNA, 22 bp, Artificial Sequence
  chemically synthesized
agggtggcattgtctccccatg

SEQ ID NO: 67463 - DNA, 22 bp, Artificial Sequence
  chemically synthesized
tctccccatggaaaaccagaga

SEQ ID NO: 67464 - DNA, 22 bp, Artificial Sequence
  chemically synthesized
cccatggaaaaccagagaggag

SEQ ID NO: 67465 - DNA, 22 bp, Artificial Sequence
  chemically synthesized
agcctggtgtggtcactcttct

SEQ ID NO: 67466 - DNA, 22 bp, Artificial Sequence
  chemically synthesized
gtgtggtcactcttctcttatc

SEQ ID NO: 67467 - DNA, 22 bp, Artificial Sequence
  chemically synthesized
ttctcttatccactaaacggtt

SEQ ID NO: 67468 - DNA, 22 bp, Artificial Sequence
  chemically synthesized
ctcttatccactaaacggttgt

SEQ ID NO: 67469 - DNA, 22 bp, Artificial Sequence
  chemically synthesized
tcttatccactaaacggttgtc

SEQ ID NO: 67470 - DNA, 22 bp, Artificial Sequence
  chemically synthesized
ttatccactaaacggttgtcac

SEQ ID NO: 67471 - DNA, 22 bp, Artificial Sequence
  chemically synthesized
atccactaaacggttgtcactg

SEQ ID NO: 67472 - DNA, 22 bp, Artificial Sequence
  chemically synthesized
tccactaaacggttgtcactgg

SEQ ID NO: 67473 - DNA, 22 bp, Artificial Sequence
  chemically synthesized
aacggttgtcactgggcactgc

SEQ ID NO: 67474 - DNA, 22 bp, Artificial Sequence
  chemically synthesized
tcactgggcactgccaccagcc

SEQ ID NO: 67475 - DNA, 22 bp, Artificial Sequence
  chemically synthesized
ggcactgccaccagccccgtgt

SEQ ID NO: 67476 - DNA, 22 bp, Artificial Sequence
  chemically synthesized
ccaccagccccgtgtttctctg

SEQ ID NO: 67477 - DNA, 22 bp, Artificial Sequence
  chemically synthesized
ctctgggtgtagggccctgggg

SEQ ID NO: 67478 - DNA, 22 bp, Artificial Sequence
  chemically synthesized
tctgggtgtagggccctgggga

SEQ ID NO: 67479 - DNA, 22 bp, Artificial Sequence
  chemically synthesized
tgggtgtagggccctggggatg

SEQ ID NO: 67480 - DNA, 22 bp, Artificial Sequence
  chemically synthesized
ggtgtagggccctggggatgtt

SEQ ID NO: 67481 - DNA, 22 bp, Artificial Sequence
  chemically synthesized
gggatgttacaggctgggggcc

SEQ ID NO: 67482 - DNA, 22 bp, Artificial Sequence
  chemically synthesized
caggctgggggccaggtgaccc

SEQ ID NO: 67483 - DNA, 22 bp, Artificial Sequence
  chemically synthesized
ggggccaggtgacccaacacta

SEQ ID NO: 67484 - DNA, 22 bp, Artificial Sequence
  chemically synthesized
cagggcaagatgagacaggctt

SEQ ID NO: 67485 - DNA, 22 bp, Artificial Sequence
  chemically synthesized
ccaggacacctagaatatcaga

SEQ ID NO: 67486 - DNA, 22 bp, Artificial Sequence
  chemically synthesized
caggacacctagaatatcagag

SEQ ID NO: 67487 - DNA, 22 bp, Artificial Sequence
  chemically synthesized
gaatatcagaggaggtggcatt

SEQ ID NO: 67488 - DNA, 22 bp, Artificial Sequence
  chemically synthesized
caagcttttgtgattcattcga

SEQ ID NO: 67489 - DNA, 22 bp, Artificial Sequence
  chemically synthesized
aagcttttgtgattcattcgat

SEQ ID NO: 67490 - DNA, 22 bp, Artificial Sequence
  chemically synthesized
ttgtgattcattcgatgttaac

SEQ ID NO: 67491 - DNA, 22 bp, Artificial Sequence
  chemically synthesized
tgtgattcattcgatgttaaca

SEQ ID NO: 67492 - DNA, 22 bp, Artificial Sequence
  chemically synthesized
gtgattcattcgatgttaacat

SEQ ID NO: 67493 - DNA, 22 bp, Artificial Sequence
  chemically synthesized
tgattcattcgatgttaacatt

SEQ ID NO: 67494 - DNA, 22 bp, Artificial Sequence
  chemically synthesized
attcgatgttaacattctttga

SEQ ID NO: 67495 - DNA, 22 bp, Artificial Sequence
  chemically synthesized
gatgttaacattctttgactca

SEQ ID NO: 67496 - DNA, 22 bp, Artificial Sequence
  chemically synthesized
acattctttgactcaatgtaga

SEQ ID NO: 67497 - DNA, 22 bp, Artificial Sequence
  chemically synthesized
tttgactcaatgtagaagagct

SEQ ID NO: 67498 - DNA, 22 bp, Artificial Sequence
  chemically synthesized
tgactcaatgtagaagagctaa

SEQ ID NO: 67499 - DNA, 22 bp, Artificial Sequence
  chemically synthesized
gactcaatgtagaagagctaaa

SEQ ID NO: 67500 - DNA, 22 bp, Artificial Sequence
  chemically synthesized
actcaatgtagaagagctaaaa

SEQ ID NO: 67501 - DNA, 22 bp, Artificial Sequence
  chemically synthesized
aatgtagaagagctaaaagtag

SEQ ID NO: 67502 - DNA, 22 bp, Artificial Sequence
  chemically synthesized
aaagtagaacaaaccaaagccg

SEQ ID NO: 67503 - DNA, 22 bp, Artificial Sequence
  chemically synthesized
ccatcttagtgtgggtggagga

SEQ ID NO: 67504 - DNA, 22 bp, Artificial Sequence
  chemically synthesized
agtgtgggtggaggacacagga

SEQ ID NO: 67505 - DNA, 22 bp, Artificial Sequence
  chemically synthesized
gtgtgggtggaggacacaggag

SEQ ID NO: 67506 - DNA, 22 bp, Artificial Sequence
  chemically synthesized
gcactgtggtgggtcccagaag

SEQ ID NO: 67507 - DNA, 22 bp, Artificial Sequence
  chemically synthesized
cactgtggtgggtcccagaaga

SEQ ID NO: 67508 - DNA, 22 bp, Artificial Sequence
  chemically synthesized
tggtgggtcccagaagaacaag

SEQ ID NO: 67509 - DNA, 22 bp, Artificial Sequence
  chemically synthesized
tgccatgccttgaatttctttt

SEQ ID NO: 67510 - DNA, 22 bp, Artificial Sequence
  chemically synthesized
gaatttcttttctgcacgacag

SEQ ID NO: 67511 - DNA, 22 bp, Artificial Sequence
  chemically synthesized
aatttcttttctgcacgacagg

SEQ ID NO: 67512 - DNA, 22 bp, Artificial Sequence
  chemically synthesized
cttttctgcacgacaggtctgc

SEQ ID NO: 67513 - DNA, 22 bp, Artificial Sequence
  chemically synthesized
ttttctgcacgacaggtctgcc

SEQ ID NO: 67514 - DNA, 22 bp, Artificial Sequence
  chemically synthesized
ttctgcacgacaggtctgccag

SEQ ID NO: 67515 - DNA, 22 bp, Artificial Sequence
  chemically synthesized
tctgcacgacaggtctgccagc

SEQ ID NO: 67516 - DNA, 22 bp, Artificial Sequence
  chemically synthesized
ctgcacgacaggtctgccagct

SEQ ID NO: 67517 - DNA, 22 bp, Artificial Sequence
  chemically synthesized
tgcacgacaggtctgccagctt

SEQ ID NO: 67518 - DNA, 22 bp, Artificial Sequence
  chemically synthesized
cacgacaggtctgccagcttac

SEQ ID NO: 67519 - DNA, 22 bp, Artificial Sequence
  chemically synthesized
ccagcttacatttacccaaact

SEQ ID NO: 67520 - DNA, 22 bp, Artificial Sequence
  chemically synthesized
acatttacccaaactgtccatt

SEQ ID NO: 67521 - DNA, 22 bp, Artificial Sequence
  chemically synthesized
catttacccaaactgtccatta

SEQ ID NO: 67522 - DNA, 22 bp, Artificial Sequence
  chemically synthesized
acccaaactgtccattactgga

SEQ ID NO: 67523 - DNA, 22 bp, Artificial Sequence
  chemically synthesized
cccaaactgtccattactggaa

SEQ ID NO: 67524 - DNA, 22 bp, Artificial Sequence
  chemically synthesized
tccattactggaacctatgatc

SEQ ID NO: 67525 - DNA, 22 bp, Artificial Sequence
  chemically synthesized
ctggaacctatgatctgaagag

SEQ ID NO: 67526 - DNA, 22 bp, Artificial Sequence
  chemically synthesized
gaacctatgatctgaagagcgt

SEQ ID NO: 67527 - DNA, 22 bp, Artificial Sequence
  chemically synthesized
tgatctgaagagcgtcctgggt

SEQ ID NO: 67528 - DNA, 22 bp, Artificial Sequence
  chemically synthesized
aagagcgtcctgggtcaactgg

SEQ ID NO: 67529 - DNA, 22 bp, Artificial Sequence
  chemically synthesized
ggtcaactgggcatcactaagg

SEQ ID NO: 67530 - DNA, 22 bp, Artificial Sequence
  chemically synthesized
ggcatcactaaggtcttcagca

SEQ ID NO: 67531 - DNA, 22 bp, Artificial Sequence
  chemically synthesized
aggtcttcagcaatggggctga

SEQ ID NO: 67532 - DNA, 22 bp, Artificial Sequence
  chemically synthesized
cagcaatggggctgacctctcc

SEQ ID NO: 67533 - DNA, 22 bp, Artificial Sequence
  chemically synthesized
agcaatggggctgacctctccg

SEQ ID NO: 67534 - DNA, 22 bp, Artificial Sequence
  chemically synthesized
acctctccggggtcacagagga

SEQ ID NO: 67535 - DNA, 22 bp, Artificial Sequence
  chemically synthesized
tccggggtcacagaggaggcac

SEQ ID NO: 67536 - DNA, 22 bp, Artificial Sequence
  chemically synthesized
cggggtcacagaggaggcaccc

SEQ ID NO: 67537 - DNA, 22 bp, Artificial Sequence
  chemically synthesized
aagctctccaaggtgagatcac

SEQ ID NO: 67538 - DNA, 22 bp, Artificial Sequence
  chemically synthesized
tccaaggtgagatcaccctgac

SEQ ID NO: 67539 - DNA, 22 bp, Artificial Sequence
  chemically synthesized
caaggtgagatcaccctgacga

SEQ ID NO: 67540 - DNA, 22 bp, Artificial Sequence
  chemically synthesized
acgaccttgttgcaccctggta

SEQ ID NO: 67541 - DNA, 22 bp, Artificial Sequence
  chemically synthesized
gttgcaccctggtatctgtagg

SEQ ID NO: 67542 - DNA, 22 bp, Artificial Sequence
  chemically synthesized
ttgcaccctggtatctgtaggg

SEQ ID NO: 67543 - DNA, 22 bp, Artificial Sequence
  chemically synthesized
caccctggtatctgtagggaag

SEQ ID NO: 67544 - DNA, 22 bp, Artificial Sequence
  chemically synthesized
gtatctgtagggaagaatgtgt

SEQ ID NO: 67545 - DNA, 22 bp, Artificial Sequence
  chemically synthesized
tagggaagaatgtgtgggggct

SEQ ID NO: 67546 - DNA, 22 bp, Artificial Sequence
  chemically synthesized
cagctctgtcctgaggctgagg

SEQ ID NO: 67547 - DNA, 22 bp, Artificial Sequence
  chemically synthesized
tgtcctgaggctgaggaagggg

SEQ ID NO: 67548 - DNA, 22 bp, Artificial Sequence
  chemically synthesized
tcctgaggctgaggaaggggcc

SEQ ID NO: 67549 - DNA, 22 bp, Artificial Sequence
  chemically synthesized
aggctgaggaaggggccgaggg

SEQ ID NO: 67550 - DNA, 22 bp, Artificial Sequence
  chemically synthesized
aggaaggggccgagggaaacaa

SEQ ID NO: 67551 - DNA, 22 bp, Artificial Sequence
  chemically synthesized
agctcctgaagatgcccgtgat

SEQ ID NO: 67552 - DNA, 22 bp, Artificial Sequence
  chemically synthesized
ctgaagatgcccgtgattcact

SEQ ID NO: 67553 - DNA, 22 bp, Artificial Sequence
  chemically synthesized
aagatgcccgtgattcactgac

SEQ ID NO: 67554 - DNA, 22 bp, Artificial Sequence
  chemically synthesized
actgacacgggacgtggtcaaa

SEQ ID NO: 67555 - DNA, 22 bp, Artificial Sequence
  chemically synthesized
acacgggacgtggtcaaacagc

SEQ ID NO: 67556 - DNA, 22 bp, Artificial Sequence
  chemically synthesized
ctgtgcagctggcactttcggg

SEQ ID NO: 67557 - DNA, 22 bp, Artificial Sequence
  chemically synthesized
tgcagctggcactttcggggcc

SEQ ID NO: 67558 - DNA, 22 bp, Artificial Sequence
  chemically synthesized
gcactttcggggcctcccttga

SEQ ID NO: 67559 - DNA, 22 bp, Artificial Sequence
  chemically synthesized
tcggggcctcccttgaggttgt

SEQ ID NO: 67560 - DNA, 22 bp, Artificial Sequence
  chemically synthesized
cggggcctcccttgaggttgtg

SEQ ID NO: 67561 - DNA, 22 bp, Artificial Sequence
  chemically synthesized
ggggcctcccttgaggttgtgt

SEQ ID NO: 67562 - DNA, 22 bp, Artificial Sequence
  chemically synthesized
ccttgaggttgtgtcactgacc

SEQ ID NO: 67563 - DNA, 22 bp, Artificial Sequence
  chemically synthesized
gaggttgtgtcactgaccctga

SEQ ID NO: 67564 - DNA, 22 bp, Artificial Sequence
  chemically synthesized
aggttgtgtcactgaccctgaa

SEQ ID NO: 67565 - DNA, 22 bp, Artificial Sequence
  chemically synthesized
tgtcactgaccctgaatttcaa

SEQ ID NO: 67566 - DNA, 22 bp, Artificial Sequence
  chemically synthesized
accctgaatttcaactttgccc

SEQ ID NO: 67567 - DNA, 22 bp, Artificial Sequence
  chemically synthesized
aatttcaactttgcccaagacc

SEQ ID NO: 67568 - DNA, 22 bp, Artificial Sequence
  chemically synthesized
caactttgcccaagaccttcta

SEQ ID NO: 67569 - DNA, 22 bp, Artificial Sequence
  chemically synthesized
aactttgcccaagaccttctag

SEQ ID NO: 67570 - DNA, 22 bp, Artificial Sequence
  chemically synthesized
tgcccaagaccttctagacatt

SEQ ID NO: 67571 - DNA, 22 bp, Artificial Sequence
  chemically synthesized
gcccaagaccttctagacattg

SEQ ID NO: 67572 - DNA, 22 bp, Artificial Sequence
  chemically synthesized
cccaagaccttctagacattgg

SEQ ID NO: 67573 - DNA, 22 bp, Artificial Sequence
  chemically synthesized
ctagacattgggccttgattta

SEQ ID NO: 67574 - DNA, 22 bp, Artificial Sequence
  chemically synthesized
tagacattgggccttgatttat

SEQ ID NO: 67575 - DNA, 22 bp, Artificial Sequence
  chemically synthesized
gacattgggccttgatttatcc

SEQ ID NO: 67576 - DNA, 22 bp, Artificial Sequence
  chemically synthesized
ggccttgatttatccatactga

SEQ ID NO: 67577 - DNA, 22 bp, Artificial Sequence
  chemically synthesized
gatttatccatactgacacaga

SEQ ID NO: 67578 - DNA, 22 bp, Artificial Sequence
  chemically synthesized
atttatccatactgacacagaa

SEQ ID NO: 67579 - DNA, 22 bp, Artificial Sequence
  chemically synthesized
atccatactgacacagaaaggt

SEQ ID NO: 67580 - DNA, 22 bp, Artificial Sequence
  chemically synthesized
tccatactgacacagaaaggtt

SEQ ID NO: 67581 - DNA, 22 bp, Artificial Sequence
  chemically synthesized
acacagaaaggtttgggctaag

SEQ ID NO: 67582 - DNA, 22 bp, Artificial Sequence
  chemically synthesized
gggctaagttgtttcaaaggaa

SEQ ID NO: 67583 - DNA, 22 bp, Artificial Sequence
  chemically synthesized
ggctaagttgtttcaaaggaat

SEQ ID NO: 67584 - DNA, 22 bp, Artificial Sequence
  chemically synthesized
agttgtttcaaaggaatttctg

SEQ ID NO: 67585 - DNA, 22 bp, Artificial Sequence
  chemically synthesized
tttcaaaggaatttctgactcc

SEQ ID NO: 67586 - DNA, 22 bp, Artificial Sequence
  chemically synthesized
caaaggaatttctgactccttc

SEQ ID NO: 67587 - DNA, 22 bp, Artificial Sequence
  chemically synthesized
aaaggaatttctgactccttcg

SEQ ID NO: 67588 - DNA, 22 bp, Artificial Sequence
  chemically synthesized
ctgactccttcgatctgtgaga

SEQ ID NO: 67589 - DNA, 22 bp, Artificial Sequence
  chemically synthesized
tgactccttcgatctgtgagat

SEQ ID NO: 67590 - DNA, 22 bp, Artificial Sequence
  chemically synthesized
actccttcgatctgtgagattt

SEQ ID NO: 67591 - DNA, 22 bp, Artificial Sequence
  chemically synthesized
cttcgatctgtgagatttggtg

SEQ ID NO: 67592 - DNA, 22 bp, Artificial Sequence
  chemically synthesized
cgatctgtgagatttggtgtct

SEQ ID NO: 67593 - DNA, 22 bp, Artificial Sequence
  chemically synthesized
gatctgtgagatttggtgtctg

SEQ ID NO: 67594 - DNA, 22 bp, Artificial Sequence
  chemically synthesized
tgagatttggtgtctgaattaa

SEQ ID NO: 67595 - DNA, 22 bp, Artificial Sequence
  chemically synthesized
ggtgtctgaattaatgaatgat

SEQ ID NO: 67596 - DNA, 22 bp, Artificial Sequence
  chemically synthesized
gtgtctgaattaatgaatgatt

SEQ ID NO: 67597 - DNA, 22 bp, Artificial Sequence
  chemically synthesized
aattaatgaatgatttcagcta

SEQ ID NO: 67598 - DNA, 22 bp, Artificial Sequence
  chemically synthesized
atgaatgatttcagctaaagat

SEQ ID NO: 67599 - DNA, 22 bp, Artificial Sequence
  chemically synthesized
cagctaaagatgacacttattt

SEQ ID NO: 67600 - DNA, 22 bp, Artificial Sequence
  chemically synthesized
agctaaagatgacacttatttt

SEQ ID NO: 67601 - DNA, 22 bp, Artificial Sequence
  chemically synthesized
aagatgacacttattttggaaa

SEQ ID NO: 67602 - DNA, 22 bp, Artificial Sequence
  chemically synthesized
attttggaaaactaaaggcgac

SEQ ID NO: 67603 - DNA, 22 bp, Artificial Sequence
  chemically synthesized
ttttggaaaactaaaggcgacc

SEQ ID NO: 67604 - DNA, 22 bp, Artificial Sequence
  chemically synthesized
tggaaaactaaaggcgaccaat

SEQ ID NO: 67605 - DNA, 22 bp, Artificial Sequence
  chemically synthesized
ggaaaactaaaggcgaccaatg

SEQ ID NO: 67606 - DNA, 22 bp, Artificial Sequence
  chemically synthesized
gaaaactaaaggcgaccaatga

SEQ ID NO: 67607 - DNA, 22 bp, Artificial Sequence
  chemically synthesized
aaggcgaccaatgaacaactgc

SEQ ID NO: 67608 - DNA, 22 bp, Artificial Sequence
  chemically synthesized
cagttccatgaatggctgcatt

SEQ ID NO: 67609 - DNA, 22 bp, Artificial Sequence
  chemically synthesized
catgaatggctgcattatcttg

SEQ ID NO: 67610 - DNA, 22 bp, Artificial Sequence
  chemically synthesized
cattatcttggggtctgggcac

SEQ ID NO: 67611 - DNA, 22 bp, Artificial Sequence
  chemically synthesized
tcttggggtctgggcactgtga

SEQ ID NO: 67612 - DNA, 22 bp, Artificial Sequence
  chemically synthesized
ggggtctgggcactgtgaaggt

SEQ ID NO: 67613 - DNA, 22 bp, Artificial Sequence
  chemically synthesized
gggtctgggcactgtgaaggtc

SEQ ID NO: 67614 - DNA, 22 bp, Artificial Sequence
  chemically synthesized
ggcactgtgaaggtcactgcca

SEQ ID NO: 67615 - DNA, 22 bp, Artificial Sequence
  chemically synthesized
tgaaggtcactgccagggtccg

SEQ ID NO: 67616 - DNA, 22 bp, Artificial Sequence
  chemically synthesized
ccagggtccgtgtcctcaagga

SEQ ID NO: 67617 - DNA, 22 bp, Artificial Sequence
  chemically synthesized
aaggagcttcaagccgtgtact

SEQ ID NO: 67618 - DNA, 22 bp, Artificial Sequence
  chemically synthesized
caagccgtgtactagaaaggag

SEQ ID NO: 67619 - DNA, 22 bp, Artificial Sequence
  chemically synthesized
aagccgtgtactagaaaggaga

SEQ ID NO: 67620 - DNA, 22 bp, Artificial Sequence
  chemically synthesized
gaaaggagagagccctggaggc

SEQ ID NO: 67621 - DNA, 22 bp, Artificial Sequence
  chemically synthesized
gaggcagacgtggagtgacgat

SEQ ID NO: 67622 - DNA, 22 bp, Artificial Sequence
  chemically synthesized
ttccctgttctgagttgtgggt

SEQ ID NO: 67623 - DNA, 22 bp, Artificial Sequence
  chemically synthesized
ccctgttctgagttgtgggtgc

SEQ ID NO: 67624 - DNA, 22 bp, Artificial Sequence
  chemically synthesized
cctgttctgagttgtgggtgca

SEQ ID NO: 67625 - DNA, 22 bp, Artificial Sequence
  chemically synthesized
ttctgagttgtgggtgcacctg

SEQ ID NO: 67626 - DNA, 22 bp, Artificial Sequence
  chemically synthesized
tgagttgtgggtgcacctgagc

SEQ ID NO: 67627 - DNA, 22 bp, Artificial Sequence
  chemically synthesized
agttgtgggtgcacctgagcag

SEQ ID NO: 67628 - DNA, 22 bp, Artificial Sequence
  chemically synthesized
tgggtgcacctgagcaggggga

SEQ ID NO: 67629 - DNA, 22 bp, Artificial Sequence
  chemically synthesized
agcagggggagaggcgcttgtc

SEQ ID NO: 67630 - DNA, 22 bp, Artificial Sequence
  chemically synthesized
gtcaggaagatggacagagggg

SEQ ID NO: 67631 - DNA, 22 bp, Artificial Sequence
  chemically synthesized
tcaggaagatggacagagggga

SEQ ID NO: 67632 - DNA, 22 bp, Artificial Sequence
  chemically synthesized
gaggaggagcaaggcctatgtg

SEQ ID NO: 67633 - DNA, 22 bp, Artificial Sequence
  chemically synthesized
aggaggagcaaggcctatgtga

SEQ ID NO: 67634 - DNA, 22 bp, Artificial Sequence
  chemically synthesized
tgtgacagggagggagaggatg

SEQ ID NO: 67635 - DNA, 22 bp, Artificial Sequence
  chemically synthesized
cctgggaggtgtccacgtgagc

SEQ ID NO: 67636 - DNA, 22 bp, Artificial Sequence
  chemically synthesized
ctgggaggtgtccacgtgagcc

SEQ ID NO: 67637 - DNA, 22 bp, Artificial Sequence
  chemically synthesized
ggaggtgtccacgtgagccttg

SEQ ID NO: 67638 - DNA, 22 bp, Artificial Sequence
  chemically synthesized
gctcgaggcctgggatcagcct

SEQ ID NO: 67639 - DNA, 22 bp, Artificial Sequence
  chemically synthesized
ctcgaggcctgggatcagcctt

SEQ ID NO: 67640 - DNA, 22 bp, Artificial Sequence
  chemically synthesized
gaggcctgggatcagccttaca

SEQ ID NO: 67641 - DNA, 22 bp, Artificial Sequence
  chemically synthesized
ggatcagccttacaacgtgtct

SEQ ID NO: 67642 - DNA, 22 bp, Artificial Sequence
  chemically synthesized
acaacgtgtctctgcttctctc

SEQ ID NO: 67643 - DNA, 22 bp, Artificial Sequence
  chemically synthesized
caacgtgtctctgcttctctcc

SEQ ID NO: 67644 - DNA, 22 bp, Artificial Sequence
  chemically synthesized
tgcttctctcccctccaggccg

SEQ ID NO: 67645 - DNA, 22 bp, Artificial Sequence
  chemically synthesized
cttctctcccctccaggccgtg

SEQ ID NO: 67646 - DNA, 22 bp, Artificial Sequence
  chemically synthesized
ctctcccctccaggccgtgcat

SEQ ID NO: 67647 - DNA, 22 bp, Artificial Sequence
  chemically synthesized
tctcccctccaggccgtgcata

SEQ ID NO: 67648 - DNA, 22 bp, Artificial Sequence
  chemically synthesized
tcccctccaggccgtgcataag

SEQ ID NO: 67649 - DNA, 22 bp, Artificial Sequence
  chemically synthesized
ccctccaggccgtgcataaggc

SEQ ID NO: 67650 - DNA, 22 bp, Artificial Sequence
  chemically synthesized
caggccgtgcataaggctgtgc

SEQ ID NO: 67651 - DNA, 22 bp, Artificial Sequence
  chemically synthesized
tgctgaccatcgacgagaaagg

SEQ ID NO: 67652 - DNA, 22 bp, Artificial Sequence
  chemically synthesized
accatcgacgagaaagggactg

SEQ ID NO: 67653 - DNA, 22 bp, Artificial Sequence
  chemically synthesized
aagctgctggggccatgttttt

SEQ ID NO: 67654 - DNA, 22 bp, Artificial Sequence
  chemically synthesized
ctggggccatgtttttagaggc

SEQ ID NO: 67655 - DNA, 22 bp, Artificial Sequence
  chemically synthesized
gggccatgtttttagaggccat

SEQ ID NO: 67656 - DNA, 22 bp, Artificial Sequence
  chemically synthesized
ttagaggccatacccatgtcta

SEQ ID NO: 67657 - DNA, 22 bp, Artificial Sequence
  chemically synthesized
tagaggccatacccatgtctat

SEQ ID NO: 67658 - DNA, 22 bp, Artificial Sequence
  chemically synthesized
agaggccatacccatgtctatc

SEQ ID NO: 67659 - DNA, 22 bp, Artificial Sequence
  chemically synthesized
gaggccatacccatgtctatcc

SEQ ID NO: 67660 - DNA, 22 bp, Artificial Sequence
  chemically synthesized
tcccccccgaggtcaagttcaa

SEQ ID NO: 67661 - DNA, 22 bp, Artificial Sequence
  chemically synthesized
aacaaaccctttgtcttcttaa

SEQ ID NO: 67662 - DNA, 22 bp, Artificial Sequence
  chemically synthesized
tgtcttcttaatgattgaacaa

SEQ ID NO: 67663 - DNA, 22 bp, Artificial Sequence
  chemically synthesized
gtcttcttaatgattgaacaaa

SEQ ID NO: 67664 - DNA, 22 bp, Artificial Sequence
  chemically synthesized
tcttcttaatgattgaacaaaa

SEQ ID NO: 67665 - DNA, 22 bp, Artificial Sequence
  chemically synthesized
cttaatgattgaacaaaatacc

SEQ ID NO: 67666 - DNA, 22 bp, Artificial Sequence
  chemically synthesized
ttaatgattgaacaaaatacca

SEQ ID NO: 67667 - DNA, 22 bp, Artificial Sequence
  chemically synthesized
aatgattgaacaaaataccaag

SEQ ID NO: 67668 - DNA, 22 bp, Artificial Sequence
  chemically synthesized
atgattgaacaaaataccaagt

SEQ ID NO: 67669 - DNA, 22 bp, Artificial Sequence
  chemically synthesized
aacaaaataccaagtctcccct

SEQ ID NO: 67670 - DNA, 22 bp, Artificial Sequence
  chemically synthesized
ccctcttcatgggaaaagtggt

SEQ ID NO: 67671 - DNA, 22 bp, Artificial Sequence
  chemically synthesized
ttcatgggaaaagtggtgaatc

SEQ ID NO: 67672 - DNA, 22 bp, Artificial Sequence
  chemically synthesized
catgggaaaagtggtgaatccc

SEQ ID NO: 67673 - DNA, 22 bp, Artificial Sequence
  chemically synthesized
atgggaaaagtggtgaatccca

SEQ ID NO: 67674 - DNA, 22 bp, Artificial Sequence
  chemically synthesized
cctctcgctcctcaacccctcc

SEQ ID NO: 67675 - DNA, 22 bp, Artificial Sequence
  chemically synthesized
tcgctcctcaacccctcccctc

SEQ ID NO: 67676 - DNA, 22 bp, Artificial Sequence
  chemically synthesized
gctcctcaacccctcccctcca

SEQ ID NO: 67677 - DNA, 22 bp, Artificial Sequence
  chemically synthesized
ctcaacccctcccctccatccc

SEQ ID NO: 67678 - DNA, 22 bp, Artificial Sequence
  chemically synthesized
aacccctcccctccatccctgg

SEQ ID NO: 67679 - DNA, 22 bp, Artificial Sequence
  chemically synthesized
ccctccatccctggccccctcc

SEQ ID NO: 67680 - DNA, 22 bp, Artificial Sequence
  chemically synthesized
catccctggccccctccctgga

SEQ ID NO: 67681 - DNA, 22 bp, Artificial Sequence
  chemically synthesized
gccccctccctggatgacatta

SEQ ID NO: 67682 - DNA, 22 bp, Artificial Sequence
  chemically synthesized
cctggatgacattaaagaaggg

SEQ ID NO: 67683 - DNA, 22 bp, Artificial Sequence
  chemically synthesized
gatgacattaaagaagggttga

SEQ ID NO: 67684 - DNA, 22 bp, Artificial Sequence
  chemically synthesized
aagaagggttgagctggtccct

SEQ ID NO: 67685 - DNA, 22 bp, Artificial Sequence
  chemically synthesized
agctggtccctgcctgcatgtg

SEQ ID NO: 67686 - DNA, 22 bp, Artificial Sequence
  chemically synthesized
gtccctgcctgcatgtgactgt

SEQ ID NO: 67687 - DNA, 22 bp, Artificial Sequence
  chemically synthesized
cctgcatgtgactgtaaatccc

SEQ ID NO: 67688 - DNA, 22 bp, Artificial Sequence
  chemically synthesized
catgtgactgtaaatccctccc

SEQ ID NO: 67689 - DNA, 22 bp, Artificial Sequence
  chemically synthesized
taaatccctcccatgttttctc

SEQ ID NO: 67690 - DNA, 22 bp, Artificial Sequence
  chemically synthesized
ccatgttttctctgagtctccc

SEQ ID NO: 67691 - DNA, 22 bp, Artificial Sequence
  chemically synthesized
tctctgagtctccctttgcctg

SEQ ID NO: 67692 - DNA, 22 bp, Artificial Sequence
  chemically synthesized
ctctgagtctccctttgcctgc

SEQ ID NO: 67693 - DNA, 22 bp, Artificial Sequence
  chemically synthesized
tctgagtctccctttgcctgct

SEQ ID NO: 67694 - DNA, 22 bp, Artificial Sequence
  chemically synthesized
tgagtctccctttgcctgctga

SEQ ID NO: 67695 - DNA, 22 bp, Artificial Sequence
  chemically synthesized
agtctccctttgcctgctgagg

SEQ ID NO: 67696 - DNA, 22 bp, Artificial Sequence
  chemically synthesized
cctttgcctgctgaggctgtat

SEQ ID NO: 67697 - DNA, 22 bp, Artificial Sequence
  chemically synthesized
tgcctgctgaggctgtatgtgg

SEQ ID NO: 67698 - DNA, 22 bp, Artificial Sequence
  chemically synthesized
gcctgctgaggctgtatgtggg

SEQ ID NO: 67699 - DNA, 22 bp, Artificial Sequence
  chemically synthesized
cctgctgaggctgtatgtgggc

SEQ ID NO: 67700 - DNA, 22 bp, Artificial Sequence
  chemically synthesized
ctgaggctgtatgtgggctcca

SEQ ID NO: 67701 - DNA, 22 bp, Artificial Sequence
  chemically synthesized
aggctgtatgtgggctccaggt

SEQ ID NO: 67702 - DNA, 22 bp, Artificial Sequence
  chemically synthesized
tatgtgggctccaggtaacagt

SEQ ID NO: 67703 - DNA, 22 bp, Artificial Sequence
  chemically synthesized
caggtaacagtgctgtcttcgg

SEQ ID NO: 67704 - DNA, 22 bp, Artificial Sequence
  chemically synthesized
tcttcgggccccctgaactgtg

SEQ ID NO: 67705 - DNA, 22 bp, Artificial Sequence
  chemically synthesized
cgggccccctgaactgtgttca

SEQ ID NO: 67706 - DNA, 22 bp, Artificial Sequence
  chemically synthesized
gggccccctgaactgtgttcat

SEQ ID NO: 67707 - DNA, 22 bp, Artificial Sequence
  chemically synthesized
aactgtgttcatggagcatctg

SEQ ID NO: 67708 - DNA, 22 bp, Artificial Sequence
  chemically synthesized
tgttcatggagcatctggctgg

SEQ ID NO: 67709 - DNA, 22 bp, Artificial Sequence
  chemically synthesized
atggagcatctggctgggtagg

SEQ ID NO: 67710 - DNA, 22 bp, Artificial Sequence
  chemically synthesized
gctgggtaggcacatgctgggc

SEQ ID NO: 67711 - DNA, 22 bp, Artificial Sequence
  chemically synthesized
ggtaggcacatgctgggcttga

SEQ ID NO: 67712 - DNA, 22 bp, Artificial Sequence
  chemically synthesized
ggcttgaatccaggggggactg

SEQ ID NO: 67713 - DNA, 22 bp, Artificial Sequence
  chemically synthesized
gaatccaggggggactgaatcc

SEQ ID NO: 67714 - DNA, 22 bp, Artificial Sequence
  chemically synthesized
aatccaggggggactgaatcct

SEQ ID NO: 67715 - DNA, 22 bp, Artificial Sequence
  chemically synthesized
aatcctcagcttacggacctgg

SEQ ID NO: 67716 - DNA, 22 bp, Artificial Sequence
  chemically synthesized
agcttacggacctgggcccatc

SEQ ID NO: 67717 - DNA, 22 bp, Artificial Sequence
  chemically synthesized
acggacctgggcccatctgttt

SEQ ID NO: 67718 - DNA, 22 bp, Artificial Sequence
  chemically synthesized
cggacctgggcccatctgtttc

SEQ ID NO: 67719 - DNA, 22 bp, Artificial Sequence
  chemically synthesized
ggcccatctgtttctggagggc

SEQ ID NO: 67720 - DNA, 22 bp, Artificial Sequence
  chemically synthesized
tttctggagggctccagtcttc

SEQ ID NO: 67721 - DNA, 22 bp, Artificial Sequence
  chemically synthesized
ctggagggctccagtcttcctt

SEQ ID NO: 67722 - DNA, 22 bp, Artificial Sequence
  chemically synthesized
tggagggctccagtcttccttg

SEQ ID NO: 67723 - DNA, 22 bp, Artificial Sequence
  chemically synthesized
gagggctccagtcttccttgtc

SEQ ID NO: 67724 - DNA, 22 bp, Artificial Sequence
  chemically synthesized
cagtcttccttgtcctgtcttg

SEQ ID NO: 67725 - DNA, 22 bp, Artificial Sequence
  chemically synthesized
ccttgtcctgtcttggagtccc

SEQ ID NO: 67726 - DNA, 22 bp, Artificial Sequence
  chemically synthesized
cttgtcctgtcttggagtcccc

SEQ ID NO: 67727 - DNA, 22 bp, Artificial Sequence
  chemically synthesized
gtcctgtcttggagtccccaag

SEQ ID NO: 67728 - DNA, 22 bp, Artificial Sequence
  chemically synthesized
tcctgtcttggagtccccaaga

SEQ ID NO: 67729 - DNA, 22 bp, Artificial Sequence
  chemically synthesized
tcttggagtccccaagaaggaa

SEQ ID NO: 67730 - DNA, 22 bp, Artificial Sequence
  chemically synthesized
ggagtccccaagaaggaatcac

SEQ ID NO: 67731 - DNA, 22 bp, Artificial Sequence
  chemically synthesized
gagtccccaagaaggaatcaca

SEQ ID NO: 67732 - DNA, 22 bp, Artificial Sequence
  chemically synthesized
caccaagcatcttcatgtcccc

SEQ ID NO: 67733 - DNA, 22 bp, Artificial Sequence
  chemically synthesized
catgtccccctgctcatccccc

SEQ ID NO: 67734 - DNA, 22 bp, Artificial Sequence
  chemically synthesized
atgtccccctgctcatccccca

SEQ ID NO: 67735 - DNA, 22 bp, Artificial Sequence
  chemically synthesized
ctcatcccccactcccccccac

SEQ ID NO: 67736 - DNA, 22 bp, Artificial Sequence
  chemically synthesized
atcccccactcccccccaccca

SEQ ID NO: 67737 - DNA, 22 bp, Artificial Sequence
  chemically synthesized
ccccccacccagagttgctcat

SEQ ID NO: 67738 - DNA, 22 bp, Artificial Sequence
  chemically synthesized
ctcatcctgccagggctggctg

SEQ ID NO: 67739 - DNA, 22 bp, Artificial Sequence
  chemically synthesized
atcctgccagggctggctgtgc

SEQ ID NO: 67740 - DNA, 22 bp, Artificial Sequence
  chemically synthesized
ccagggctggctgtgcccaccc

SEQ ID NO: 67741 - DNA, 22 bp, Artificial Sequence
  chemically synthesized
gctgtgcccaccccaaggctgc

SEQ ID NO: 67742 - DNA, 22 bp, Artificial Sequence
  chemically synthesized
tgcccaccccaaggctgccctc

SEQ ID NO: 67743 - DNA, 22 bp, Artificial Sequence
  chemically synthesized
ccctcctgggggccccagaact

SEQ ID NO: 67744 - DNA, 22 bp, Artificial Sequence
  chemically synthesized
ctgggggccccagaactgcctg

SEQ ID NO: 67745 - DNA, 22 bp, Artificial Sequence
  chemically synthesized
ggggccccagaactgcctgatc

SEQ ID NO: 67746 - DNA, 22 bp, Artificial Sequence
  chemically synthesized
cctgatcgtgccgtggcccagt

SEQ ID NO: 67747 - DNA, 22 bp, Artificial Sequence
  chemically synthesized
atcgtgccgtggcccagttttg

SEQ ID NO: 67748 - DNA, 22 bp, Artificial Sequence
  chemically synthesized
tgtggcatctgcagcaacacaa

SEQ ID NO: 67749 - DNA, 22 bp, Artificial Sequence
  chemically synthesized
gtggcatctgcagcaacacaag

SEQ ID NO: 67750 - DNA, 22 bp, Artificial Sequence
  chemically synthesized
tggcatctgcagcaacacaaga

SEQ ID NO: 67751 - DNA, 22 bp, Artificial Sequence
  chemically synthesized
cagcaacacaagagagaggaca

SEQ ID NO: 67752 - DNA, 22 bp, Artificial Sequence
  chemically synthesized
ctcttgacccgctgtcacctaa

SEQ ID NO: 67753 - DNA, 22 bp, Artificial Sequence
  chemically synthesized
ttgacccgctgtcacctaacca

SEQ ID NO: 67754 - DNA, 22 bp, Artificial Sequence
  chemically synthesized
gacccgctgtcacctaaccaga

SEQ ID NO: 67755 - DNA, 22 bp, Artificial Sequence
  chemically synthesized
acccgctgtcacctaaccagac

SEQ ID NO: 67756 - DNA, 22 bp, Artificial Sequence
  chemically synthesized
tcacctaaccagactcgggccc

SEQ ID NO: 67757 - DNA, 22 bp, Artificial Sequence
  chemically synthesized
accagactcgggccctgcacct

SEQ ID NO: 67758 - DNA, 22 bp, Artificial Sequence
  chemically synthesized
gggccctgcacctctcaggcac

SEQ ID NO: 67759 - DNA, 22 bp, Artificial Sequence
  chemically synthesized
cacctctcaggcacttctggaa

SEQ ID NO: 67760 - DNA, 22 bp, Artificial Sequence
  chemically synthesized
tcaggcacttctggaaaatgac

SEQ ID NO: 67761 - DNA, 22 bp, Artificial Sequence
  chemically synthesized
aggcacttctggaaaatgactg

SEQ ID NO: 67762 - DNA, 22 bp, Artificial Sequence
  chemically synthesized
ctggaaaatgactgaggcagat

SEQ ID NO: 67763 - DNA, 22 bp, Artificial Sequence
  chemically synthesized
tggaaaatgactgaggcagatt

SEQ ID NO: 67764 - DNA, 22 bp, Artificial Sequence
  chemically synthesized
gaaaatgactgaggcagattct

SEQ ID NO: 67765 - DNA, 22 bp, Artificial Sequence
  chemically synthesized
aggcagattcttcctgaagccc

SEQ ID NO: 67766 - DNA, 22 bp, Artificial Sequence
  chemically synthesized
ttcctgaagcccattctccatg

SEQ ID NO: 67767 - DNA, 22 bp, Artificial Sequence
  chemically synthesized
cctgaagcccattctccatggg

SEQ ID NO: 67768 - DNA, 22 bp, Artificial Sequence
  chemically synthesized
ctgaagcccattctccatgggg

SEQ ID NO: 67769 - DNA, 22 bp, Artificial Sequence
  chemically synthesized
aagcccattctccatggggcaa

SEQ ID NO: 67770 - DNA, 22 bp, Artificial Sequence
  chemically synthesized
tccatggggcaacaaggacacc

SEQ ID NO: 67771 - DNA, 22 bp, Artificial Sequence
  chemically synthesized
catggggcaacaaggacaccta

SEQ ID NO: 67772 - DNA, 22 bp, Artificial Sequence
  chemically synthesized
ttctgtccttgtccttccatcg

SEQ ID NO: 67773 - DNA, 22 bp, Artificial Sequence
  chemically synthesized
tgtccttgtccttccatcgctg

SEQ ID NO: 67774 - DNA, 22 bp, Artificial Sequence
  chemically synthesized
tccttgtccttccatcgctgcc

SEQ ID NO: 67775 - DNA, 22 bp, Artificial Sequence
  chemically synthesized
gtccttccatcgctgccccaga

SEQ ID NO: 67776 - DNA, 22 bp, Artificial Sequence
  chemically synthesized
tccttccatcgctgccccagaa

SEQ ID NO: 67777 - DNA, 22 bp, Artificial Sequence
  chemically synthesized
ccatcgctgccccagaaagcct

SEQ ID NO: 67778 - DNA, 22 bp, Artificial Sequence
  chemically synthesized
catcgctgccccagaaagcctc

SEQ ID NO: 67779 - DNA, 22 bp, Artificial Sequence
  chemically synthesized
ccccagaaagcctcacatatct

SEQ ID NO: 67780 - DNA, 22 bp, Artificial Sequence
  chemically synthesized
acatatctccgtttagaatcag

SEQ ID NO: 67781 - DNA, 22 bp, Artificial Sequence
  chemically synthesized
cgtttagaatcaggtcccttct

SEQ ID NO: 67782 - DNA, 22 bp, Artificial Sequence
  chemically synthesized
agaatcaggtcccttctcccca

SEQ ID NO: 67783 - DNA, 22 bp, Artificial Sequence
  chemically synthesized
gaatcaggtcccttctccccag

SEQ ID NO: 67784 - DNA, 22 bp, Artificial Sequence
  chemically synthesized
ctccccagatgaagaggagggt

SEQ ID NO: 67785 - DNA, 22 bp, Artificial Sequence
  chemically synthesized
tccccagatgaagaggagggtc

SEQ ID NO: 67786 - DNA, 22 bp, Artificial Sequence
  chemically synthesized
cccagatgaagaggagggtctc

SEQ ID NO: 67787 - DNA, 22 bp, Artificial Sequence
  chemically synthesized
tgctttgttttctctatctcct

SEQ ID NO: 67788 - DNA, 22 bp, Artificial Sequence
  chemically synthesized
ctttgttttctctatctcctcc

SEQ ID NO: 67789 - DNA, 22 bp, Artificial Sequence
  chemically synthesized
tgttttctctatctcctcctca

SEQ ID NO: 67790 - DNA, 22 bp, Artificial Sequence
  chemically synthesized
gttttctctatctcctcctcag

SEQ ID NO: 67791 - DNA, 22 bp, Artificial Sequence
  chemically synthesized
ttttctctatctcctcctcaga

SEQ ID NO: 67792 - DNA, 22 bp, Artificial Sequence
  chemically synthesized
tctctatctcctcctcagactt

SEQ ID NO: 67793 - DNA, 22 bp, Artificial Sequence
  chemically synthesized
ctctatctcctcctcagacttg

SEQ ID NO: 67794 - DNA, 22 bp, Artificial Sequence
  chemically synthesized
tctatctcctcctcagacttga

SEQ ID NO: 67795 - DNA, 22 bp, Artificial Sequence
  chemically synthesized
tatctcctcctcagacttgacc

SEQ ID NO: 67796 - DNA, 22 bp, Artificial Sequence
  chemically synthesized
tctcctcctcagacttgaccag

SEQ ID NO: 67797 - DNA, 22 bp, Artificial Sequence
  chemically synthesized
ctcctcagacttgaccaggccc

SEQ ID NO: 67798 - DNA, 22 bp, Artificial Sequence
  chemically synthesized
ctcagacttgaccaggcccagc

SEQ ID NO: 67799 - DNA, 22 bp, Artificial Sequence
  chemically synthesized
agacttgaccaggcccagcagg

SEQ ID NO: 67800 - DNA, 22 bp, Artificial Sequence
  chemically synthesized
gaccaggcccagcaggccccag

SEQ ID NO: 67801 - DNA, 22 bp, Artificial Sequence
  chemically synthesized
accaggcccagcaggccccaga

SEQ ID NO: 67802 - DNA, 22 bp, Artificial Sequence
  chemically synthesized
ccctatatcccttctcctccct

SEQ ID NO: 67803 - DNA, 22 bp, Artificial Sequence
  chemically synthesized
tatcccttctcctccctagtca

SEQ ID NO: 67804 - DNA, 22 bp, Artificial Sequence
  chemically synthesized
ctcctccctagtcacatggcca

SEQ ID NO: 67805 - DNA, 22 bp, Artificial Sequence
  chemically synthesized
tcctccctagtcacatggccat

SEQ ID NO: 67806 - DNA, 22 bp, Artificial Sequence
  chemically synthesized
ctccctagtcacatggccatag

SEQ ID NO: 67807 - DNA, 22 bp, Artificial Sequence
  chemically synthesized
cctagtcacatggccataggcc

SEQ ID NO: 67808 - DNA, 22 bp, Artificial Sequence
  chemically synthesized
gtcacatggccataggcctgct

SEQ ID NO: 67809 - DNA, 22 bp, Artificial Sequence
  chemically synthesized
ctgatggctcaggaaggccatt

SEQ ID NO: 67810 - DNA, 22 bp, Artificial Sequence
  chemically synthesized
atggctcaggaaggccattgca

SEQ ID NO: 67811 - DNA, 22 bp, Artificial Sequence
  chemically synthesized
aggaaggccattgcaaggactc

SEQ ID NO: 67812 - DNA, 22 bp, Artificial Sequence
  chemically synthesized
caaggactcctcagctatggga

SEQ ID NO: 67813 - DNA, 22 bp, Artificial Sequence
  chemically synthesized
ctcagctatgggagaggaagca

SEQ ID NO: 67814 - DNA, 22 bp, Artificial Sequence
  chemically synthesized
agctatgggagaggaagcacat

SEQ ID NO: 67815 - DNA, 22 bp, Artificial Sequence
  chemically synthesized
tgggagaggaagcacatcaccc

SEQ ID NO: 67816 - DNA, 22 bp, Artificial Sequence
  chemically synthesized
acccccgcaacccctccctttc

SEQ ID NO: 67817 - DNA, 22 bp, Artificial Sequence
  chemically synthesized
cctttcctcctctgagtcccga

SEQ ID NO: 67818 - DNA, 22 bp, Artificial Sequence
  chemically synthesized
tcctcctctgagtcccgactgg

SEQ ID NO: 67819 - DNA, 22 bp, Artificial Sequence
  chemically synthesized
cctcctctgagtcccgactggg

SEQ ID NO: 67820 - DNA, 22 bp, Artificial Sequence
  chemically synthesized
ctcctctgagtcccgactgggg

SEQ ID NO: 67821 - DNA, 22 bp, Artificial Sequence
  chemically synthesized
ctctgagtcccgactggggcca

SEQ ID NO: 67822 - DNA, 22 bp, Artificial Sequence
  chemically synthesized
tgagtcccgactggggccacat

SEQ ID NO: 67823 - DNA, 22 bp, Artificial Sequence
  chemically synthesized
agtcccgactggggccacatgc

SEQ ID NO: 67824 - DNA, 22 bp, Artificial Sequence
  chemically synthesized
gggccacatgcagcctgacttc

SEQ ID NO: 67825 - DNA, 22 bp, Artificial Sequence
  chemically synthesized
acttctttgtgcctgttgctgt

SEQ ID NO: 67826 - DNA, 22 bp, Artificial Sequence
  chemically synthesized
ctttgtgcctgttgctgtccct

SEQ ID NO: 67827 - DNA, 22 bp, Artificial Sequence
  chemically synthesized
tttgtgcctgttgctgtccctg

SEQ ID NO: 67828 - DNA, 22 bp, Artificial Sequence
  chemically synthesized
tgtgcctgttgctgtccctgca

SEQ ID NO: 67829 - DNA, 22 bp, Artificial Sequence
  chemically synthesized
gtgcctgttgctgtccctgcag

SEQ ID NO: 67830 - DNA, 22 bp, Artificial Sequence
  chemically synthesized
tgcctgttgctgtccctgcagt

SEQ ID NO: 67831 - DNA, 22 bp, Artificial Sequence
  chemically synthesized
ttgctgtccctgcagtcttcag

SEQ ID NO: 67832 - DNA, 22 bp, Artificial Sequence
  chemically synthesized
ctgtccctgcagtcttcagagg

SEQ ID NO: 67833 - DNA, 22 bp, Artificial Sequence
  chemically synthesized
tccctgcagtcttcagagggcc

SEQ ID NO: 67834 - DNA, 22 bp, Artificial Sequence
  chemically synthesized
cagtcttcagagggccaccgca

SEQ ID NO: 67835 - DNA, 22 bp, Artificial Sequence
  chemically synthesized
cagagggccaccgcagctccag

SEQ ID NO: 67836 - DNA, 22 bp, Artificial Sequence
  chemically synthesized
agagggccaccgcagctccagt

SEQ ID NO: 67837 - DNA, 22 bp, Artificial Sequence
  chemically synthesized
cagtgccacggcaggaggctgt

SEQ ID NO: 67838 - DNA, 22 bp, Artificial Sequence
  chemically synthesized
ttcctgaatagcccctgtggta

SEQ ID NO: 67839 - DNA, 22 bp, Artificial Sequence
  chemically synthesized
ctgaatagcccctgtggtaagg

SEQ ID NO: 67840 - DNA, 22 bp, Artificial Sequence
  chemically synthesized
aatagcccctgtggtaagggcc

SEQ ID NO: 67841 - DNA, 22 bp, Artificial Sequence
  chemically synthesized
tggtaagggccaggagagtcct

SEQ ID NO: 67842 - DNA, 22 bp, Artificial Sequence
  chemically synthesized
ccatcctccaaggccctgctaa

SEQ ID NO: 67843 - DNA, 22 bp, Artificial Sequence
  chemically synthesized
catcctccaaggccctgctaaa

SEQ ID NO: 67844 - DNA, 22 bp, Artificial Sequence
  chemically synthesized
caaggccctgctaaaggacaca

SEQ ID NO: 67845 - DNA, 22 bp, Artificial Sequence
  chemically synthesized
ctaaaggacacagcagccagga

SEQ ID NO: 67846 - DNA, 22 bp, Artificial Sequence
  chemically synthesized
aaggacacagcagccaggaagt

SEQ ID NO: 67847 - DNA, 22 bp, Artificial Sequence
  chemically synthesized
ggcccctagctgaaggacagcc

SEQ ID NO: 67848 - DNA, 22 bp, Artificial Sequence
  chemically synthesized
gctgaaggacagcctgctccct

SEQ ID NO: 67849 - DNA, 22 bp, Artificial Sequence
  chemically synthesized
aaggacagcctgctccctccgt

SEQ ID NO: 67850 - DNA, 22 bp, Artificial Sequence
  chemically synthesized
ctccctccgtctctaccaggaa

SEQ ID NO: 67851 - DNA, 22 bp, Artificial Sequence
  chemically synthesized
cctccgtctctaccaggaatgg

SEQ ID NO: 67852 - DNA, 22 bp, Artificial Sequence
  chemically synthesized
cgtctctaccaggaatggcctt

SEQ ID NO: 67853 - DNA, 22 bp, Artificial Sequence
  chemically synthesized
taccaggaatggccttgtccta

SEQ ID NO: 67854 - DNA, 22 bp, Artificial Sequence
  chemically synthesized
ccaggaatggccttgtcctatg

SEQ ID NO: 67855 - DNA, 22 bp, Artificial Sequence
  chemically synthesized
gtcctatggaaggcactgcccc

SEQ ID NO: 67856 - DNA, 22 bp, Artificial Sequence
  chemically synthesized
tcctatggaaggcactgcccca

SEQ ID NO: 67857 - DNA, 22 bp, Artificial Sequence
  chemically synthesized
tggaaggcactgccccatccca

SEQ ID NO: 67858 - DNA, 22 bp, Artificial Sequence
  chemically synthesized
ccccatcccaaactaatctagg

SEQ ID NO: 67859 - DNA, 22 bp, Artificial Sequence
  chemically synthesized
atctaggaatcactgtctaacc

SEQ ID NO: 67860 - DNA, 22 bp, Artificial Sequence
  chemically synthesized
ggaatcactgtctaaccactca

SEQ ID NO: 67861 - DNA, 22 bp, Artificial Sequence
  chemically synthesized
tctaaccactcactgtcatgaa

SEQ ID NO: 67862 - DNA, 22 bp, Artificial Sequence
  chemically synthesized
accactcactgtcatgaatgtg

SEQ ID NO: 67863 - DNA, 22 bp, Artificial Sequence
  chemically synthesized
actgtcatgaatgtgtacttaa

SEQ ID NO: 67864 - DNA, 22 bp, Artificial Sequence
  chemically synthesized
tcatgaatgtgtacttaaagga

SEQ ID NO: 67865 - DNA, 22 bp, Artificial Sequence
  chemically synthesized
aaaggatgaggttgagtcatac

SEQ ID NO: 67866 - DNA, 22 bp, Artificial Sequence
  chemically synthesized
aaggatgaggttgagtcatacc

SEQ ID NO: 67867 - DNA, 22 bp, Artificial Sequence
  chemically synthesized
agtcataccaaatagtgatttc

SEQ ID NO: 67868 - DNA, 22 bp, Artificial Sequence
  chemically synthesized
cgatagttcaaaatggtgaaat

SEQ ID NO: 67869 - DNA, 22 bp, Artificial Sequence
  chemically synthesized
gatagttcaaaatggtgaaatt

SEQ ID NO: 67870 - DNA, 22 bp, Artificial Sequence
  chemically synthesized
aaaatggtgaaattagcaattc

SEQ ID NO: 67871 - DNA, 22 bp, Artificial Sequence
  chemically synthesized
gcaattctacatgattcagtct

SEQ ID NO: 67872 - DNA, 22 bp, Artificial Sequence
  chemically synthesized
tacatgattcagtctaatcaat

SEQ ID NO: 67873 - DNA, 22 bp, Artificial Sequence
  chemically synthesized
catgattcagtctaatcaatgg

SEQ ID NO: 67874 - DNA, 22 bp, Artificial Sequence
  chemically synthesized
agtctaatcaatggataccgac

SEQ ID NO: 67875 - DNA, 22 bp, Artificial Sequence
  chemically synthesized
atcaatggataccgactgtttc

SEQ ID NO: 67876 - DNA, 22 bp, Artificial Sequence
  chemically synthesized
tttcccacacaagtctcctgtt

SEQ ID NO: 67877 - DNA, 22 bp, Artificial Sequence
  chemically synthesized
cccacacaagtctcctgttctc

SEQ ID NO: 67878 - DNA, 22 bp, Artificial Sequence
  chemically synthesized
ccacacaagtctcctgttctct

SEQ ID NO: 67879 - DNA, 22 bp, Artificial Sequence
  chemically synthesized
ctgttctcttaagcttactcac

SEQ ID NO: 67880 - DNA, 22 bp, Artificial Sequence
  chemically synthesized
ttctcttaagcttactcactga

SEQ ID NO: 67881 - DNA, 22 bp, Artificial Sequence
  chemically synthesized
tcttaagcttactcactgacag

SEQ ID NO: 67882 - DNA, 22 bp, Artificial Sequence
  chemically synthesized
ttaagcttactcactgacagcc

SEQ ID NO: 67883 - DNA, 22 bp, Artificial Sequence
  chemically synthesized
aagcttactcactgacagcctt

SEQ ID NO: 67884 - DNA, 22 bp, Artificial Sequence
  chemically synthesized
agcttactcactgacagccttt

SEQ ID NO: 67885 - DNA, 22 bp, Artificial Sequence
  chemically synthesized
actcactgacagcctttcactc

SEQ ID NO: 67886 - DNA, 22 bp, Artificial Sequence
  chemically synthesized
ctcactgacagcctttcactct

SEQ ID NO: 67887 - DNA, 22 bp, Artificial Sequence
  chemically synthesized
actgacagcctttcactctcca

SEQ ID NO: 67888 - DNA, 22 bp, Artificial Sequence
  chemically synthesized
acagcctttcactctccacaaa

SEQ ID NO: 67889 - DNA, 22 bp, Artificial Sequence
  chemically synthesized
tcactctccacaaatacattaa

SEQ ID NO: 67890 - DNA, 22 bp, Artificial Sequence
  chemically synthesized
cactctccacaaatacattaaa

SEQ ID NO: 67891 - DNA, 22 bp, Artificial Sequence
  chemically synthesized
actctccacaaatacattaaag

SEQ ID NO: 67892 - DNA, 22 bp, Artificial Sequence
  chemically synthesized
tccacaaatacattaaagatat

SEQ ID NO: 67893 - DNA, 22 bp, Artificial Sequence
  chemically synthesized
cacaaatacattaaagatatgg

SEQ ID NO: 67894 - DNA, 22 bp, Artificial Sequence
  chemically synthesized
aagatatggccatcaccaagcc

SEQ ID NO: 67895 - DNA, 22 bp, Artificial Sequence
  chemically synthesized
ggatgacaccagacctgagagt

SEQ ID NO: 67896 - DNA, 22 bp, Artificial Sequence
  chemically synthesized
agagtctgaagacctggatcca

SEQ ID NO: 67897 - DNA, 22 bp, Artificial Sequence
  chemically synthesized
aagacctggatccaagttctga

SEQ ID NO: 67898 - DNA, 22 bp, Artificial Sequence
  chemically synthesized
gatccaagttctgacttttccc

SEQ ID NO: 67899 - DNA, 22 bp, Artificial Sequence
  chemically synthesized
tgacttttccccctgacagctg

SEQ ID NO: 67900 - DNA, 22 bp, Artificial Sequence
  chemically synthesized
acttttccccctgacagctgtg

SEQ ID NO: 67901 - DNA, 22 bp, Artificial Sequence
  chemically synthesized
ttccccctgacagctgtgtgac

SEQ ID NO: 67902 - DNA, 22 bp, Artificial Sequence
  chemically synthesized
tccccctgacagctgtgtgacc

SEQ ID NO: 67903 - DNA, 22 bp, Artificial Sequence
  chemically synthesized
ccccctgacagctgtgtgacct

SEQ ID NO: 67904 - DNA, 22 bp, Artificial Sequence
  chemically synthesized
cccctgacagctgtgtgacctt

SEQ ID NO: 67905 - DNA, 22 bp, Artificial Sequence
  chemically synthesized
acagctgtgtgaccttcgtgaa

SEQ ID NO: 67906 - DNA, 22 bp, Artificial Sequence
  chemically synthesized
tgtgaccttcgtgaagtcgcca

SEQ ID NO: 67907 - DNA, 22 bp, Artificial Sequence
  chemically synthesized
cgtgaagtcgccaaacctctct

SEQ ID NO: 67908 - DNA, 22 bp, Artificial Sequence
  chemically synthesized
gtgaagtcgccaaacctctctg

SEQ ID NO: 67909 - DNA, 22 bp, Artificial Sequence
  chemically synthesized
tctgagccccagtcattgctag

SEQ ID NO: 67910 - DNA, 22 bp, Artificial Sequence
  chemically synthesized
tgagccccagtcattgctagta

SEQ ID NO: 67911 - DNA, 22 bp, Artificial Sequence
  chemically synthesized
agccccagtcattgctagtaag

SEQ ID NO: 67912 - DNA, 22 bp, Artificial Sequence
  chemically synthesized
ctagtaagacctgcctttgagt

SEQ ID NO: 67913 - DNA, 22 bp, Artificial Sequence
  chemically synthesized
gtaagacctgcctttgagttgg

SEQ ID NO: 67914 - DNA, 22 bp, Artificial Sequence
  chemically synthesized
cctttgagttggtatgatgttc

SEQ ID NO: 67915 - DNA, 22 bp, Artificial Sequence
  chemically synthesized
tgagttggtatgatgttcaagt

SEQ ID NO: 67916 - DNA, 22 bp, Artificial Sequence
  chemically synthesized
gagttggtatgatgttcaagtt

SEQ ID NO: 67917 - DNA, 22 bp, Artificial Sequence
  chemically synthesized
agttggtatgatgttcaagtta

SEQ ID NO: 67918 - DNA, 22 bp, Artificial Sequence
  chemically synthesized
gtatgatgttcaagttagataa

SEQ ID NO: 67919 - DNA, 22 bp, Artificial Sequence
  chemically synthesized
aagttagataacaaaatgttta

SEQ ID NO: 67920 - DNA, 22 bp, Artificial Sequence
  chemically synthesized
gataacaaaatgtttataccca

SEQ ID NO: 67921 - DNA, 22 bp, Artificial Sequence
  chemically synthesized
atacccattagaacagagaata

SEQ ID NO: 67922 - DNA, 22 bp, Artificial Sequence
  chemically synthesized
tacccattagaacagagaataa

SEQ ID NO: 67923 - DNA, 22 bp, Artificial Sequence
  chemically synthesized
gaacagagaataaatagaacta

SEQ ID NO: 67924 - DNA, 22 bp, Artificial Sequence
  chemically synthesized
catttcttgcacttatgagctt

SEQ ID NO: 67925 - DNA, 22 bp, Artificial Sequence
  chemically synthesized
cttgcacttatgagctttctgt

SEQ ID NO: 67926 - DNA, 22 bp, Artificial Sequence
  chemically synthesized
ttgcacttatgagctttctgtg

SEQ ID NO: 67927 - DNA, 22 bp, Artificial Sequence
  chemically synthesized
gcacttatgagctttctgtgaa

SEQ ID NO: 67928 - DNA, 22 bp, Artificial Sequence
  chemically synthesized
cacttatgagctttctgtgaat

SEQ ID NO: 67929 - DNA, 22 bp, Artificial Sequence
  chemically synthesized
atgagctttctgtgaatcagac

SEQ ID NO: 67930 - DNA, 22 bp, Artificial Sequence
  chemically synthesized
tgagctttctgtgaatcagaca

SEQ ID NO: 67931 - DNA, 22 bp, Artificial Sequence
  chemically synthesized
tctgtgaatcagacatccctat

SEQ ID NO: 67932 - DNA, 22 bp, Artificial Sequence
  chemically synthesized
ctgtgaatcagacatccctatg

SEQ ID NO: 67933 - DNA, 22 bp, Artificial Sequence
  chemically synthesized
tgtgaatcagacatccctatga

SEQ ID NO: 67934 - DNA, 22 bp, Artificial Sequence
  chemically synthesized
tgaatcagacatccctatgaag

SEQ ID NO: 67935 - DNA, 22 bp, Artificial Sequence
  chemically synthesized
tgaagtacctcccctggctgtt

SEQ ID NO: 67936 - DNA, 22 bp, Artificial Sequence
  chemically synthesized
ccctggctgtttctcatttact

SEQ ID NO: 67937 - DNA, 22 bp, Artificial Sequence
  chemically synthesized
gctgtttctcatttactcactg

SEQ ID NO: 67938 - DNA, 22 bp, Artificial Sequence
  chemically synthesized
tttctcatttactcactgtagc

SEQ ID NO: 67939 - DNA, 22 bp, Artificial Sequence
  chemically synthesized
ctcatttactcactgtagcagc

SEQ ID NO: 67940 - DNA, 22 bp, Artificial Sequence
  chemically synthesized
tcatttactcactgtagcagca

SEQ ID NO: 67941 - DNA, 22 bp, Artificial Sequence
  chemically synthesized
atttactcactgtagcagcact

SEQ ID NO: 67942 - DNA, 22 bp, Artificial Sequence
  chemically synthesized
actcactgtagcagcactgcga

SEQ ID NO: 67943 - DNA, 22 bp, Artificial Sequence
  chemically synthesized
ctcactgtagcagcactgcgat

SEQ ID NO: 67944 - DNA, 22 bp, Artificial Sequence
  chemically synthesized
actgtagcagcactgcgatgtg

SEQ ID NO: 67945 - DNA, 22 bp, Artificial Sequence
  chemically synthesized
tagcagcactgcgatgtgtgag

SEQ ID NO: 67946 - DNA, 22 bp, Artificial Sequence
  chemically synthesized
cgatgtgtgagtatatctgctg

SEQ ID NO: 67947 - DNA, 22 bp, Artificial Sequence
  chemically synthesized
ctgtgctcttaaactccaaatc

SEQ ID NO: 67948 - DNA, 22 bp, Artificial Sequence
  chemically synthesized
tgctcttaaactccaaatctga

SEQ ID NO: 67949 - DNA, 22 bp, Artificial Sequence
  chemically synthesized
ttaaactccaaatctgaggaaa

SEQ ID NO: 67950 - DNA, 22 bp, Artificial Sequence
  chemically synthesized
aaactccaaatctgaggaaact

SEQ ID NO: 67951 - DNA, 22 bp, Artificial Sequence
  chemically synthesized
aactccaaatctgaggaaactg

SEQ ID NO: 67952 - DNA, 22 bp, Artificial Sequence
  chemically synthesized
caaatctgaggaaactgaggct

SEQ ID NO: 67953 - DNA, 22 bp, Artificial Sequence
  chemically synthesized
aggaaactgaggctcagagagg

SEQ ID NO: 67954 - DNA, 22 bp, Artificial Sequence
  chemically synthesized
aggctcagagaggctactggtc

SEQ ID NO: 67955 - DNA, 22 bp, Artificial Sequence
  chemically synthesized
agagaggctactggtctcccac

SEQ ID NO: 67956 - DNA, 22 bp, Artificial Sequence
  chemically synthesized
ctggtctcccacaatgtcacac

SEQ ID NO: 67957 - DNA, 22 bp, Artificial Sequence
  chemically synthesized
gtctcccacaatgtcacacagc

SEQ ID NO: 67958 - DNA, 22 bp, Artificial Sequence
  chemically synthesized
ccacaatgtcacacagctcata

SEQ ID NO: 67959 - DNA, 22 bp, Artificial Sequence
  chemically synthesized
ataagtggcaaagctggcttga

SEQ ID NO: 67960 - DNA, 22 bp, Artificial Sequence
  chemically synthesized
gcttgatgggctacttgttcct

SEQ ID NO: 67961 - DNA, 22 bp, Artificial Sequence
  chemically synthesized
gatgggctacttgttcctctga

SEQ ID NO: 67962 - DNA, 22 bp, Artificial Sequence
  chemically synthesized
atgggctacttgttcctctgaa

SEQ ID NO: 67963 - DNA, 22 bp, Artificial Sequence
  chemically synthesized
cttgttcctctgaaccatacca

SEQ ID NO: 67964 - DNA, 22 bp, Artificial Sequence
  chemically synthesized
gttcctctgaaccataccacct

SEQ ID NO: 67965 - DNA, 22 bp, Artificial Sequence
  chemically synthesized
ttcctctgaaccataccacctc

SEQ ID NO: 67966 - DNA, 22 bp, Artificial Sequence
  chemically synthesized
ctctgaaccataccacctcacc

SEQ ID NO: 67967 - DNA, 22 bp, Artificial Sequence
  chemically synthesized
tgaaccataccacctcaccaca

SEQ ID NO: 67968 - DNA, 22 bp, Artificial Sequence
  chemically synthesized
aaccataccacctcaccacact

SEQ ID NO: 67969 - DNA, 22 bp, Artificial Sequence
  chemically synthesized
accacactctccccttcgaggg

SEQ ID NO: 67970 - DNA, 22 bp, Artificial Sequence
  chemically synthesized
tccccttcgagggtcacgctaa

SEQ ID NO: 67971 - DNA, 22 bp, Artificial Sequence
  chemically synthesized
cccttcgagggtcacgctaaac

SEQ ID NO: 67972 - DNA, 22 bp, Artificial Sequence
  chemically synthesized
cgagggtcacgctaaacttctg

SEQ ID NO: 67973 - DNA, 22 bp, Artificial Sequence
  chemically synthesized
gagggtcacgctaaacttctgc

SEQ ID NO: 67974 - DNA, 22 bp, Artificial Sequence
  chemically synthesized
aacttctgcagaggtaattcct

SEQ ID NO: 67975 - DNA, 22 bp, Artificial Sequence
  chemically synthesized
ctgcagaggtaattcctcctta

SEQ ID NO: 67976 - DNA, 22 bp, Artificial Sequence
  chemically synthesized
tgcagaggtaattcctccttaa

SEQ ID NO: 67977 - DNA, 22 bp, Artificial Sequence
  chemically synthesized
cagaggtaattcctccttaaac

SEQ ID NO: 67978 - DNA, 22 bp, Artificial Sequence
  chemically synthesized
ctccttaaaccagaagggttgc

SEQ ID NO: 67979 - DNA, 22 bp, Artificial Sequence
  chemically synthesized
cttaaaccagaagggttgctgg

SEQ ID NO: 67980 - DNA, 22 bp, Artificial Sequence
  chemically synthesized
aaaccagaagggttgctggtgg

SEQ ID NO: 67981 - DNA, 22 bp, Artificial Sequence
  chemically synthesized
aaccagaagggttgctggtggc

SEQ ID NO: 67982 - DNA, 22 bp, Artificial Sequence
  chemically synthesized
ctggtggcccacagctcacgcc

SEQ ID NO: 67983 - DNA, 22 bp, Artificial Sequence
  chemically synthesized
gtggcccacagctcacgcctag

SEQ ID NO: 67984 - DNA, 22 bp, Artificial Sequence
  chemically synthesized
acgcctagcacacttcatgaga

SEQ ID NO: 67985 - DNA, 22 bp, Artificial Sequence
  chemically synthesized
gcacacttcatgagaaaaacac

SEQ ID NO: 67986 - DNA, 22 bp, Artificial Sequence
  chemically synthesized
catgagaaaaacaccctgtgcc

SEQ ID NO: 67987 - DNA, 22 bp, Artificial Sequence
  chemically synthesized
atgagaaaaacaccctgtgccc

SEQ ID NO: 67988 - DNA, 22 bp, Artificial Sequence
  chemically synthesized
tgcccagtgtggagcaggcatt

SEQ ID NO: 67989 - DNA, 22 bp, Artificial Sequence
  chemically synthesized
agctgaaggtggtgagcagaag

SEQ ID NO: 67990 - DNA, 22 bp, Artificial Sequence
  chemically synthesized
aaggtggtgagcagaagctcat

SEQ ID NO: 67991 - DNA, 22 bp, Artificial Sequence
  chemically synthesized
atccaccagatgttgacacagc

SEQ ID NO: 67992 - DNA, 22 bp, Artificial Sequence
  chemically synthesized
acacagcccgcagccttgggcg

SEQ ID NO: 67993 - DNA, 22 bp, Artificial Sequence
  chemically synthesized
gggcgacccacaggactcctct

SEQ ID NO: 67994 - DNA, 22 bp, Artificial Sequence
  chemically synthesized
ggcgacccacaggactcctctt

SEQ ID NO: 67995 - DNA, 22 bp, Artificial Sequence
  chemically synthesized
ctcttatttaactggcatttgg

SEQ ID NO: 67996 - DNA, 22 bp, Artificial Sequence
  chemically synthesized
ttatttaactggcatttggtag

SEQ ID NO: 67997 - DNA, 22 bp, Artificial Sequence
  chemically synthesized
atttaactggcatttggtagga

SEQ ID NO: 67998 - DNA, 22 bp, Artificial Sequence
  chemically synthesized
tttaactggcatttggtaggag

SEQ ID NO: 67999 - DNA, 22 bp, Artificial Sequence
  chemically synthesized
aactggcatttggtaggagaac

SEQ ID NO: 68000 - DNA, 22 bp, Artificial Sequence
  chemically synthesized
actggcatttggtaggagaaca

SEQ ID NO: 68001 - DNA, 22 bp, Artificial Sequence
  chemically synthesized
gcatttggtaggagaacagggg

SEQ ID NO: 68002 - DNA, 22 bp, Artificial Sequence
  chemically synthesized
ggtaggagaacaggggcagagt

SEQ ID NO: 68003 - DNA, 22 bp, Artificial Sequence
  chemically synthesized
gtaggagaacaggggcagagtc

SEQ ID NO: 68004 - DNA, 22 bp, Artificial Sequence
  chemically synthesized
gctttctggagagcccagggca

SEQ ID NO: 68005 - DNA, 22 bp, Artificial Sequence
  chemically synthesized
tctggagagcccagggcaggga

SEQ ID NO: 68006 - DNA, 22 bp, Artificial Sequence
  chemically synthesized
ctggagagcccagggcagggaa

SEQ ID NO: 68007 - DNA, 22 bp, Artificial Sequence
  chemically synthesized
tggagagcccagggcagggaag

SEQ ID NO: 68008 - DNA, 22 bp, Artificial Sequence
  chemically synthesized
gagagcccagggcagggaagga

SEQ ID NO: 68009 - DNA, 22 bp, Artificial Sequence
  chemically synthesized
agggcggtcaccttagacacca

SEQ ID NO: 68010 - DNA, 22 bp, Artificial Sequence
  chemically synthesized
agacaccatcgttttactttga

SEQ ID NO: 68011 - DNA, 22 bp, Artificial Sequence
  chemically synthesized
gacaccatcgttttactttgaa

SEQ ID NO: 68012 - DNA, 22 bp, Artificial Sequence
  chemically synthesized
tactttgaagaattgtctgtca

SEQ ID NO: 68013 - DNA, 22 bp, Artificial Sequence
  chemically synthesized
actttgaagaattgtctgtcac

SEQ ID NO: 68014 - DNA, 22 bp, Artificial Sequence
  chemically synthesized
ctttgaagaattgtctgtcaca

SEQ ID NO: 68015 - DNA, 22 bp, Artificial Sequence
  chemically synthesized
tgaagaattgtctgtcacacac

SEQ ID NO: 68016 - DNA, 22 bp, Artificial Sequence
  chemically synthesized
gaagaattgtctgtcacacacg

SEQ ID NO: 68017 - DNA, 22 bp, Artificial Sequence
  chemically synthesized
aagaattgtctgtcacacacga

SEQ ID NO: 68018 - DNA, 22 bp, Artificial Sequence
  chemically synthesized
tctgtcacacacgagttgacag

SEQ ID NO: 68019 - DNA, 22 bp, Artificial Sequence
  chemically synthesized
tcacacacgagttgacagtcag

SEQ ID NO: 68020 - DNA, 22 bp, Artificial Sequence
  chemically synthesized
acagtcaggatgggagagaccc

SEQ ID NO: 68021 - DNA, 22 bp, Artificial Sequence
  chemically synthesized
aaactagcataacctcccagag

SEQ ID NO: 68022 - DNA, 22 bp, Artificial Sequence
  chemically synthesized
gcataacctcccagagggaatt

SEQ ID NO: 68023 - DNA, 22 bp, Artificial Sequence
  chemically synthesized
ccagagggaattcctgggctcc

SEQ ID NO: 68024 - DNA, 22 bp, Artificial Sequence
  chemically synthesized
ctgggctcccctgggaatcaac

SEQ ID NO: 68025 - DNA, 22 bp, Artificial Sequence
  chemically synthesized
ggctcccctgggaatcaacagg

SEQ ID NO: 68026 - DNA, 22 bp, Artificial Sequence
  chemically synthesized
ccctgggaatcaacagggatca

SEQ ID NO: 68027 - DNA, 22 bp, Artificial Sequence
  chemically synthesized
ggaatcaacagggatcagtcaa

SEQ ID NO: 68028 - DNA, 22 bp, Artificial Sequence
  chemically synthesized
attatgaggaagacaaatatat

SEQ ID NO: 68029 - DNA, 22 bp, Artificial Sequence
  chemically synthesized
tgaggaagacaaatatatgtca

SEQ ID NO: 68030 - DNA, 22 bp, Artificial Sequence
  chemically synthesized
agcttcactgtatcttccagag

SEQ ID NO: 68031 - DNA, 22 bp, Artificial Sequence
  chemically synthesized
cactgtatcttccagagtttta

SEQ ID NO: 68032 - DNA, 22 bp, Artificial Sequence
  chemically synthesized
actgtatcttccagagttttaa

SEQ ID NO: 68033 - DNA, 22 bp, Artificial Sequence
  chemically synthesized
tatcttccagagttttaaaaaa

SEQ ID NO: 68034 - DNA, 22 bp, Artificial Sequence
  chemically synthesized
ccagagttttaaaaaaatgtat

SEQ ID NO: 68035 - DNA, 22 bp, Artificial Sequence
  chemically synthesized
cagagttttaaaaaaatgtatt

SEQ ID NO: 68036 - DNA, 22 bp, Artificial Sequence
  chemically synthesized
taaaaaaatgtattcactgtcc

SEQ ID NO: 68037 - DNA, 22 bp, Artificial Sequence
  chemically synthesized
aaaaaaatgtattcactgtcca

SEQ ID NO: 68038 - DNA, 22 bp, Artificial Sequence
  chemically synthesized
aaaaaatgtattcactgtccaa

SEQ ID NO: 68039 - DNA, 22 bp, Artificial Sequence
  chemically synthesized
actgtccaacgtgatcctccag

SEQ ID NO: 68040 - DNA, 22 bp, Artificial Sequence
  chemically synthesized
tccaacgtgatcctccagacag

SEQ ID NO: 68041 - DNA, 22 bp, Artificial Sequence
  chemically synthesized
cagacaggttctgcaggacgca

SEQ ID NO: 68042 - DNA, 22 bp, Artificial Sequence
  chemically synthesized
tgcaggacgcagcctaggactc

SEQ ID NO: 68043 - DNA, 22 bp, Artificial Sequence
  chemically synthesized
caggacgcagcctaggactcat

SEQ ID NO: 68044 - DNA, 22 bp, Artificial Sequence
  chemically synthesized
ggactcattatccccaaagtac

SEQ ID NO: 68045 - DNA, 22 bp, Artificial Sequence
  chemically synthesized
attatccccaaagtacacatgg

SEQ ID NO: 68046 - DNA, 22 bp, Artificial Sequence
  chemically synthesized
tccccaaagtacacatggggaa

SEQ ID NO: 68047 - DNA, 22 bp, Artificial Sequence
  chemically synthesized
aggcccagcaggtcaaatgctc

SEQ ID NO: 68048 - DNA, 22 bp, Artificial Sequence
  chemically synthesized
tgtccagtgtgggcctggaagg

SEQ ID NO: 68049 - DNA, 22 bp, Artificial Sequence
  chemically synthesized
tccagtgtgggcctggaaggca

SEQ ID NO: 68050 - DNA, 22 bp, Artificial Sequence
  chemically synthesized
gaaggcaggtcttctccactgt

SEQ ID NO: 68051 - DNA, 22 bp, Artificial Sequence
  chemically synthesized
ctccactgttaggcctggctgt

SEQ ID NO: 68052 - DNA, 22 bp, Artificial Sequence
  chemically synthesized
tccactgttaggcctggctgtc

SEQ ID NO: 68053 - DNA, 22 bp, Artificial Sequence
  chemically synthesized
cactgttaggcctggctgtccc

SEQ ID NO: 68054 - DNA, 22 bp, Artificial Sequence
  chemically synthesized
ttaggcctggctgtccccaaca

SEQ ID NO: 68055 - DNA, 22 bp, Artificial Sequence
  chemically synthesized
ggcctggctgtccccaacagca

SEQ ID NO: 68056 - DNA, 22 bp, Artificial Sequence
  chemically synthesized
gctgtccccaacagcacatact

SEQ ID NO: 68057 - DNA, 22 bp, Artificial Sequence
  chemically synthesized
tccccaacagcacatacttcct

SEQ ID NO: 68058 - DNA, 22 bp, Artificial Sequence
  chemically synthesized
cctcagtccatatgggatcacg

SEQ ID NO: 68059 - DNA, 22 bp, Artificial Sequence
  chemically synthesized
ctcagtccatatgggatcacga

SEQ ID NO: 68060 - DNA, 22 bp, Artificial Sequence
  chemically synthesized
agtccatatgggatcacgataa

SEQ ID NO: 68061 - DNA, 22 bp, Artificial Sequence
  chemically synthesized
catcctccaggaccacactgca

SEQ ID NO: 68062 - DNA, 22 bp, Artificial Sequence
  chemically synthesized
caggaccacactgcatcaacct

SEQ ID NO: 68063 - DNA, 22 bp, Artificial Sequence
  chemically synthesized
catcaacctgctgtgccctaac

SEQ ID NO: 68064 - DNA, 22 bp, Artificial Sequence
  chemically synthesized
ctgtgccctaacatcagctgaa

SEQ ID NO: 68065 - DNA, 22 bp, Artificial Sequence
  chemically synthesized
tgccctaacatcagctgaaggc

SEQ ID NO: 68066 - DNA, 22 bp, Artificial Sequence
  chemically synthesized
acatcagctgaaggccaagctg

SEQ ID NO: 68067 - DNA, 22 bp, Artificial Sequence
  chemically synthesized
aaggccaagctgcggggcaccc

SEQ ID NO: 68068 - DNA, 22 bp, Artificial Sequence
  chemically synthesized
cggggcaccctgggtgttccaa

SEQ ID NO: 68069 - DNA, 22 bp, Artificial Sequence
  chemically synthesized
ggtgttccaagtcactttccct

SEQ ID NO: 68070 - DNA, 22 bp, Artificial Sequence
  chemically synthesized
caagtcactttccctctgcagg

SEQ ID NO: 68071 - DNA, 22 bp, Artificial Sequence
  chemically synthesized
tccctctgcaggcaggaacctc

SEQ ID NO: 68072 - DNA, 22 bp, Artificial Sequence
  chemically synthesized
ccctctgcaggcaggaacctca

SEQ ID NO: 68073 - DNA, 22 bp, Artificial Sequence
  chemically synthesized
cctctgcaggcaggaacctcat

SEQ ID NO: 68074 - DNA, 22 bp, Artificial Sequence
  chemically synthesized
tgcaggcaggaacctcatcctg

SEQ ID NO: 68075 - DNA, 22 bp, Artificial Sequence
  chemically synthesized
caggcaggaacctcatcctgct

SEQ ID NO: 68076 - DNA, 22 bp, Artificial Sequence
  chemically synthesized
atcctgctctgaaacagatgag

SEQ ID NO: 68077 - DNA, 22 bp, Artificial Sequence
  chemically synthesized
ctctgaaacagatgagagggaa

SEQ ID NO: 68078 - DNA, 22 bp, Artificial Sequence
  chemically synthesized
tgaaacagatgagagggaaacg

SEQ ID NO: 68079 - DNA, 22 bp, Artificial Sequence
  chemically synthesized
aaacagatgagagggaaacgca

SEQ ID NO: 68080 - DNA, 22 bp, Artificial Sequence
  chemically synthesized
ccagctcagccaggaaccttag

SEQ ID NO: 68081 - DNA, 22 bp, Artificial Sequence
  chemically synthesized
cagctcagccaggaaccttaga

SEQ ID NO: 68082 - DNA, 22 bp, Artificial Sequence
  chemically synthesized
agccaggaaccttagagtcctg

SEQ ID NO: 68083 - DNA, 22 bp, Artificial Sequence
  chemically synthesized
agagtcctgaccttttacctcg

SEQ ID NO: 68084 - DNA, 22 bp, Artificial Sequence
  chemically synthesized
gagtcctgaccttttacctcgc

SEQ ID NO: 68085 - DNA, 22 bp, Artificial Sequence
  chemically synthesized
accttttacctcgcctaggagt

SEQ ID NO: 68086 - DNA, 22 bp, Artificial Sequence
  chemically synthesized
ttacctcgcctaggagtttgca

SEQ ID NO: 68087 - DNA, 22 bp, Artificial Sequence
  chemically synthesized
tacctcgcctaggagtttgcag

SEQ ID NO: 68088 - DNA, 22 bp, Artificial Sequence
  chemically synthesized
acctcgcctaggagtttgcagg

SEQ ID NO: 68089 - DNA, 22 bp, Artificial Sequence
  chemically synthesized
cctcgcctaggagtttgcaggg

SEQ ID NO: 68090 - DNA, 22 bp, Artificial Sequence
  chemically synthesized
gcctaggagtttgcaggggaga

SEQ ID NO: 68091 - DNA, 22 bp, Artificial Sequence
  chemically synthesized
ggagtttgcaggggagagaaca

SEQ ID NO: 68092 - DNA, 22 bp, Artificial Sequence
  chemically synthesized
gcaggggagagaacacacgaat

SEQ ID NO: 68093 - DNA, 22 bp, Artificial Sequence
  chemically synthesized
caggggagagaacacacgaatt

SEQ ID NO: 68094 - DNA, 22 bp, Artificial Sequence
  chemically synthesized
cggattttaagcctaaataaag

SEQ ID NO: 68095 - DNA, 22 bp, Artificial Sequence
  chemically synthesized
ggattttaagcctaaataaagg

SEQ ID NO: 68096 - DNA, 22 bp, Artificial Sequence
  chemically synthesized
taagcctaaataaaggaagcct

SEQ ID NO: 68097 - DNA, 22 bp, Artificial Sequence
  chemically synthesized
aagcctaaataaaggaagcctt

SEQ ID NO: 68098 - DNA, 22 bp, Artificial Sequence
  chemically synthesized
agcctaaataaaggaagcctta

SEQ ID NO: 68099 - DNA, 22 bp, Artificial Sequence
  chemically synthesized
aataaaggaagccttagtttga

SEQ ID NO: 68100 - DNA, 22 bp, Artificial Sequence
  chemically synthesized
agtttgaagtgcaagctctgcc

SEQ ID NO: 68101 - DNA, 22 bp, Artificial Sequence
  chemically synthesized
gtttgaagtgcaagctctgccg

SEQ ID NO: 68102 - DNA, 22 bp, Artificial Sequence
  chemically synthesized
gaagtgcaagctctgccggaca

SEQ ID NO: 68103 - DNA, 22 bp, Artificial Sequence
  chemically synthesized
aagtgcaagctctgccggacag

SEQ ID NO: 68104 - DNA, 22 bp, Artificial Sequence
  chemically synthesized
tgccggacagggggcaccctgt

SEQ ID NO: 68105 - DNA, 22 bp, Artificial Sequence
  chemically synthesized
ccggacagggggcaccctgtga

SEQ ID NO: 68106 - DNA, 22 bp, Artificial Sequence
  chemically synthesized
tgagccccatttgttaagagga

SEQ ID NO: 68107 - DNA, 22 bp, Artificial Sequence
  chemically synthesized
gttaagaggacaatagtcagag

SEQ ID NO: 68108 - DNA, 22 bp, Artificial Sequence
  chemically synthesized
ttaagaggacaatagtcagaga

SEQ ID NO: 68109 - DNA, 22 bp, Artificial Sequence
  chemically synthesized
agaggacaatagtcagagagct

SEQ ID NO: 68110 - DNA, 22 bp, Artificial Sequence
  chemically synthesized
ccaggctctcacaccagaaaca

SEQ ID NO: 68111 - DNA, 22 bp, Artificial Sequence
  chemically synthesized
caggctctcacaccagaaacag

SEQ ID NO: 68112 - DNA, 22 bp, Artificial Sequence
  chemically synthesized
tcacaccagaaacaggaaatac

SEQ ID NO: 68113 - DNA, 22 bp, Artificial Sequence
  chemically synthesized
acaccagaaacaggaaatacag

SEQ ID NO: 68114 - DNA, 22 bp, Artificial Sequence
  chemically synthesized
cacactgatctccttcccagga

SEQ ID NO: 68115 - DNA, 22 bp, Artificial Sequence
  chemically synthesized
acactgatctccttcccaggag

SEQ ID NO: 68116 - DNA, 22 bp, Artificial Sequence
  chemically synthesized
atctccttcccaggagcaactt

SEQ ID NO: 68117 - DNA, 22 bp, Artificial Sequence
  chemically synthesized
cttcccaggagcaacttgatcc

SEQ ID NO: 68118 - DNA, 22 bp, Artificial Sequence
  chemically synthesized
cccaggagcaacttgatcctct

SEQ ID NO: 68119 - DNA, 22 bp, Artificial Sequence
  chemically synthesized
ccaggagcaacttgatcctctc

SEQ ID NO: 68120 - DNA, 22 bp, Artificial Sequence
  chemically synthesized
gatcctctccataaatccgagc

SEQ ID NO: 68121 - DNA, 22 bp, Artificial Sequence
  chemically synthesized
atcctctccataaatccgagcg

SEQ ID NO: 68122 - DNA, 22 bp, Artificial Sequence
  chemically synthesized
tccataaatccgagcgggaagc

SEQ ID NO: 68123 - DNA, 22 bp, Artificial Sequence
  chemically synthesized
cataaatccgagcgggaagcat

SEQ ID NO: 68124 - DNA, 22 bp, Artificial Sequence
  chemically synthesized
atccaaacaacaaacaagcaaa

SEQ ID NO: 68125 - DNA, 22 bp, Artificial Sequence
  chemically synthesized
tccaaacaacaaacaagcaaac

SEQ ID NO: 68126 - DNA, 22 bp, Artificial Sequence
  chemically synthesized
tgtatgggggatagagagaatg

SEQ ID NO: 68127 - DNA, 22 bp, Artificial Sequence
  chemically synthesized
gtctatggcagtggggagcagt

SEQ ID NO: 68128 - DNA, 22 bp, Artificial Sequence
  chemically synthesized
tggcagtggggagcagtgaata

SEQ ID NO: 68129 - DNA, 22 bp, Artificial Sequence
  chemically synthesized
ggtggagagggtcagggtgtaa

SEQ ID NO: 68130 - DNA, 22 bp, Artificial Sequence
  chemically synthesized
tccagaggcatgagaaacagtc

SEQ ID NO: 68131 - DNA, 22 bp, Artificial Sequence
  chemically synthesized
ccagaggcatgagaaacagtca

SEQ ID NO: 68132 - DNA, 22 bp, Artificial Sequence
  chemically synthesized
cagaggcatgagaaacagtcag

SEQ ID NO: 68133 - DNA, 22 bp, Artificial Sequence
  chemically synthesized
cacccacagatgacctcaaaca

SEQ ID NO: 68134 - DNA, 22 bp, Artificial Sequence
  chemically synthesized
aaacaccccaagtgctccttga

SEQ ID NO: 68135 - DNA, 22 bp, Artificial Sequence
  chemically synthesized
cttgaaaggctgaggcttttgt

SEQ ID NO: 68136 - DNA, 22 bp, Artificial Sequence
  chemically synthesized
gaaaggctgaggcttttgtgtt

SEQ ID NO: 68137 - DNA, 22 bp, Artificial Sequence
  chemically synthesized
aaaggctgaggcttttgtgttg

SEQ ID NO: 68138 - DNA, 22 bp, Artificial Sequence
  chemically synthesized
aggcttttgtgttgctcttggt

SEQ ID NO: 68139 - DNA, 22 bp, Artificial Sequence
  chemically synthesized
ttgtgttgctcttggttggatt

SEQ ID NO: 68140 - DNA, 22 bp, Artificial Sequence
  chemically synthesized
tgtgttgctcttggttggatta

SEQ ID NO: 68141 - DNA, 22 bp, Artificial Sequence
  chemically synthesized
gtgttgctcttggttggattat

SEQ ID NO: 68142 - DNA, 22 bp, Artificial Sequence
  chemically synthesized
tgttgctcttggttggattatt

SEQ ID NO: 68143 - DNA, 22 bp, Artificial Sequence
  chemically synthesized
ctcttggttggattattcacag

SEQ ID NO: 68144 - DNA, 22 bp, Artificial Sequence
  chemically synthesized
ttggttggattattcacaggca

SEQ ID NO: 68145 - DNA, 22 bp, Artificial Sequence
  chemically synthesized
ggttggattattcacaggcaat

SEQ ID NO: 68146 - DNA, 22 bp, Artificial Sequence
  chemically synthesized
gttggattattcacaggcaatg

SEQ ID NO: 68147 - DNA, 22 bp, Artificial Sequence
  chemically synthesized
gattattcacaggcaatgaagt

SEQ ID NO: 68148 - DNA, 22 bp, Artificial Sequence
  chemically synthesized
ttcacaggcaatgaagtaaaca

SEQ ID NO: 68149 - DNA, 22 bp, Artificial Sequence
  chemically synthesized
acaggcaatgaagtaaacaagg

SEQ ID NO: 68150 - DNA, 22 bp, Artificial Sequence
  chemically synthesized
agaaccagggacagcttccgca

SEQ ID NO: 68151 - DNA, 22 bp, Artificial Sequence
  chemically synthesized
ccgcaggaacctgggtcagttc

SEQ ID NO: 68152 - DNA, 22 bp, Artificial Sequence
  chemically synthesized
cgcaggaacctgggtcagttct

SEQ ID NO: 68153 - DNA, 22 bp, Artificial Sequence
  chemically synthesized
ggtcagttctaaaaggacaaat

SEQ ID NO: 68154 - DNA, 22 bp, Artificial Sequence
  chemically synthesized
taaaaggacaaatggaatgacc

SEQ ID NO: 68155 - DNA, 22 bp, Artificial Sequence
  chemically synthesized
aaaggacaaatggaatgaccct

SEQ ID NO: 68156 - DNA, 22 bp, Artificial Sequence
  chemically synthesized
agtagagaagtcagagaaaggc

SEQ ID NO: 68157 - DNA, 22 bp, Artificial Sequence
  chemically synthesized
tcactgaggcaaactccctccc

SEQ ID NO: 68158 - DNA, 22 bp, Artificial Sequence
  chemically synthesized
actgaggcaaactccctcccca

SEQ ID NO: 68159 - DNA, 22 bp, Artificial Sequence
  chemically synthesized
aggcaaactccctccccagcag

SEQ ID NO: 68160 - DNA, 22 bp, Artificial Sequence
  chemically synthesized
cctccccagcagggacccaggc

SEQ ID NO: 68161 - DNA, 22 bp, Artificial Sequence
  chemically synthesized
cccagcagggacccaggcagca

SEQ ID NO: 68162 - DNA, 22 bp, Artificial Sequence
  chemically synthesized
ggaaaagcaggagtgtcactat

SEQ ID NO: 68163 - DNA, 22 bp, Artificial Sequence
  chemically synthesized
ttgtatcatatgggagagggca

SEQ ID NO: 68164 - DNA, 22 bp, Artificial Sequence
  chemically synthesized
tatcatatgggagagggcaggc

SEQ ID NO: 68165 - DNA, 22 bp, Artificial Sequence
  chemically synthesized
tgtgctctcagggaagttcctc

SEQ ID NO: 68166 - DNA, 22 bp, Artificial Sequence
  chemically synthesized
tcagggaagttcctcaacttct

SEQ ID NO: 68167 - DNA, 22 bp, Artificial Sequence
  chemically synthesized
agggaagttcctcaacttctct

SEQ ID NO: 68168 - DNA, 22 bp, Artificial Sequence
  chemically synthesized
ctcaacttctctgtgccgtagt

SEQ ID NO: 68169 - DNA, 22 bp, Artificial Sequence
  chemically synthesized
aacttctctgtgccgtagtttc

SEQ ID NO: 68170 - DNA, 22 bp, Artificial Sequence
  chemically synthesized
ctctgtgccgtagtttcctcat

SEQ ID NO: 68171 - DNA, 22 bp, Artificial Sequence
  chemically synthesized
tctgtgccgtagtttcctcatc

SEQ ID NO: 68172 - DNA, 22 bp, Artificial Sequence
  chemically synthesized
tgtgccgtagtttcctcatctg

SEQ ID NO: 68173 - DNA, 22 bp, Artificial Sequence
  chemically synthesized
tgccgtagtttcctcatctgca

SEQ ID NO: 68174 - DNA, 22 bp, Artificial Sequence
  chemically synthesized
cctcatctgcaaaatgtaaatc

SEQ ID NO: 68175 - DNA, 22 bp, Artificial Sequence
  chemically synthesized
ctcatctgcaaaatgtaaatca

SEQ ID NO: 68176 - DNA, 22 bp, Artificial Sequence
  chemically synthesized
atctgcaaaatgtaaatcaaat

SEQ ID NO: 68177 - DNA, 22 bp, Artificial Sequence
  chemically synthesized
caaaatgtaaatcaaatttgag

SEQ ID NO: 68178 - DNA, 22 bp, Artificial Sequence
  chemically synthesized
gaggtttcaatgcaatgactta

SEQ ID NO: 68179 - DNA, 22 bp, Artificial Sequence
  chemically synthesized
aggtttcaatgcaatgacttat

SEQ ID NO: 68180 - DNA, 22 bp, Artificial Sequence
  chemically synthesized
caatgcaatgacttatttctct

SEQ ID NO: 68181 - DNA, 22 bp, Artificial Sequence
  chemically synthesized
aatgcaatgacttatttctcta

SEQ ID NO: 68182 - DNA, 22 bp, Artificial Sequence
  chemically synthesized
atttctctaaagttccttgtcc

SEQ ID NO: 68183 - DNA, 22 bp, Artificial Sequence
  chemically synthesized
tttctctaaagttccttgtcct

SEQ ID NO: 68184 - DNA, 22 bp, Artificial Sequence
  chemically synthesized
ctctaaagttccttgtccttgt

SEQ ID NO: 68185 - DNA, 22 bp, Artificial Sequence
  chemically synthesized
tctaaagttccttgtccttgtc

SEQ ID NO: 68186 - DNA, 22 bp, Artificial Sequence
  chemically synthesized
taaagttccttgtccttgtccc

SEQ ID NO: 68187 - DNA, 22 bp, Artificial Sequence
  chemically synthesized
aagttccttgtccttgtcccat

SEQ ID NO: 68188 - DNA, 22 bp, Artificial Sequence
  chemically synthesized
cttgtccttgtcccatgtagcc

SEQ ID NO: 68189 - DNA, 22 bp, Artificial Sequence
  chemically synthesized
gtccttgtcccatgtagcccag

SEQ ID NO: 68190 - DNA, 22 bp, Artificial Sequence
  chemically synthesized
tccttgtcccatgtagcccaga

SEQ ID NO: 68191 - DNA, 22 bp, Artificial Sequence
  chemically synthesized
gtcccatgtagcccagaaatct

SEQ ID NO: 68192 - DNA, 22 bp, Artificial Sequence
  chemically synthesized
tcccatgtagcccagaaatctt

SEQ ID NO: 68193 - DNA, 22 bp, Artificial Sequence
  chemically synthesized
cctctggcctagttgtggagcc

SEQ ID NO: 68194 - DNA, 22 bp, Artificial Sequence
  chemically synthesized
ctctggcctagttgtggagcct

SEQ ID NO: 68195 - DNA, 22 bp, Artificial Sequence
  chemically synthesized
tggcctagttgtggagcctggc

SEQ ID NO: 68196 - DNA, 22 bp, Artificial Sequence
  chemically synthesized
gcctagttgtggagcctggcct

SEQ ID NO: 68197 - DNA, 22 bp, Artificial Sequence
  chemically synthesized
gttgtggagcctggcctaagtc

SEQ ID NO: 68198 - DNA, 22 bp, Artificial Sequence
  chemically synthesized
tggagcctggcctaagtcgcac

SEQ ID NO: 68199 - DNA, 22 bp, Artificial Sequence
  chemically synthesized
gcctaagtcgcacattgctgga

SEQ ID NO: 68200 - DNA, 22 bp, Artificial Sequence
  chemically synthesized
agtcgcacattgctggagatgg

SEQ ID NO: 68201 - DNA, 22 bp, Artificial Sequence
  chemically synthesized
ctggagatggtgaagctgacca

SEQ ID NO: 68202 - DNA, 22 bp, Artificial Sequence
  chemically synthesized
gagatggtgaagctgaccagca

SEQ ID NO: 68203 - DNA, 22 bp, Artificial Sequence
  chemically synthesized
accagcatgagaggtcagtttc

SEQ ID NO: 68204 - DNA, 22 bp, Artificial Sequence
  chemically synthesized
ctagaagcccaaatcccaacag

SEQ ID NO: 68205 - DNA, 22 bp, Artificial Sequence
  chemically synthesized
tagaagcccaaatcccaacagg

SEQ ID NO: 68206 - DNA, 22 bp, Artificial Sequence
  chemically synthesized
gaagcccaaatcccaacaggca

SEQ ID NO: 68207 - DNA, 22 bp, Artificial Sequence
  chemically synthesized
accctccaatatcagctctatc

SEQ ID NO: 68208 - DNA, 22 bp, Artificial Sequence
  chemically synthesized
caatatcagctctatcagaaac

SEQ ID NO: 68209 - DNA, 22 bp, Artificial Sequence
  chemically synthesized
tatcagaaacaaacaaacaaaa

SEQ ID NO: 68210 - DNA, 22 bp, Artificial Sequence
  chemically synthesized
tcagaaacaaacaaacaaaaac

SEQ ID NO: 68211 - DNA, 22 bp, Artificial Sequence
  chemically synthesized
attcatttgtccttttcctcaa

SEQ ID NO: 68212 - DNA, 22 bp, Artificial Sequence
  chemically synthesized
ttcatttgtccttttcctcaaa

SEQ ID NO: 68213 - DNA, 22 bp, Artificial Sequence
  chemically synthesized
atttgtccttttcctcaaatgg

SEQ ID NO: 68214 - DNA, 22 bp, Artificial Sequence
  chemically synthesized
gtccttttcctcaaatgggtgg

SEQ ID NO: 68215 - DNA, 22 bp, Artificial Sequence
  chemically synthesized
tccttttcctcaaatgggtggc

SEQ ID NO: 68216 - DNA, 22 bp, Artificial Sequence
  chemically synthesized
ttcctcaaatgggtggcacttg

SEQ ID NO: 68217 - DNA, 22 bp, Artificial Sequence
  chemically synthesized
tcctcaaatgggtggcacttgg

SEQ ID NO: 68218 - DNA, 22 bp, Artificial Sequence
  chemically synthesized
cctcaaatgggtggcacttggg

SEQ ID NO: 68219 - DNA, 22 bp, Artificial Sequence
  chemically synthesized
ctcaaatgggtggcacttgggc

SEQ ID NO: 68220 - DNA, 22 bp, Artificial Sequence
  chemically synthesized
aaatgggtggcacttgggcagg

SEQ ID NO: 68221 - DNA, 22 bp, Artificial Sequence
  chemically synthesized
gggcagggcagaagggctggtt

SEQ ID NO: 68222 - DNA, 22 bp, Artificial Sequence
  chemically synthesized
ggcagggcagaagggctggtta

SEQ ID NO: 68223 - DNA, 22 bp, Artificial Sequence
  chemically synthesized
gttatccaagcttggaagatgc

SEQ ID NO: 68224 - DNA, 22 bp, Artificial Sequence
  chemically synthesized
tccaagcttggaagatgctgac

SEQ ID NO: 68225 - DNA, 22 bp, Artificial Sequence
  chemically synthesized
ggaagatgctgacagcagacgc

SEQ ID NO: 68226 - DNA, 22 bp, Artificial Sequence
  chemically synthesized
gaagatgctgacagcagacgct

SEQ ID NO: 68227 - DNA, 22 bp, Artificial Sequence
  chemically synthesized
acagcagacgcttcaatggcag

SEQ ID NO: 68228 - DNA, 22 bp, Artificial Sequence
  chemically synthesized
caatggcagtaggagttttctg

SEQ ID NO: 68229 - DNA, 22 bp, Artificial Sequence
  chemically synthesized
aatggcagtaggagttttctga

SEQ ID NO: 68230 - DNA, 22 bp, Artificial Sequence
  chemically synthesized
tctgatcactgtcattggtatc

SEQ ID NO: 68231 - DNA, 22 bp, Artificial Sequence
  chemically synthesized
ctgatcactgtcattggtatca

SEQ ID NO: 68232 - DNA, 22 bp, Artificial Sequence
  chemically synthesized
tgatcactgtcattggtatcac

SEQ ID NO: 68233 - DNA, 22 bp, Artificial Sequence
  chemically synthesized
atcactgtcattggtatcacgc

SEQ ID NO: 68234 - DNA, 22 bp, Artificial Sequence
  chemically synthesized
tcattggtatcacgcttactgt

SEQ ID NO: 68235 - DNA, 22 bp, Artificial Sequence
  chemically synthesized
gtatcacgcttactgttgaaat

SEQ ID NO: 68236 - DNA, 22 bp, Artificial Sequence
  chemically synthesized
actgttgaaatcgtgacatcag

SEQ ID NO: 68237 - DNA, 22 bp, Artificial Sequence
  chemically synthesized
ctgttgaaatcgtgacatcagg

SEQ ID NO: 68238 - DNA, 22 bp, Artificial Sequence
  chemically synthesized
ttgaaatcgtgacatcaggaat

SEQ ID NO: 68239 - DNA, 22 bp, Artificial Sequence
  chemically synthesized
aaatcgtgacatcaggaatgat

SEQ ID NO: 68240 - DNA, 22 bp, Artificial Sequence
  chemically synthesized
gagtcagatggtctggagcggg

SEQ ID NO: 68241 - DNA, 22 bp, Artificial Sequence
  chemically synthesized
gagcggggaagtgaggagctga

SEQ ID NO: 68242 - DNA, 22 bp, Artificial Sequence
  chemically synthesized
aaacctccttcagtctggttgc

SEQ ID NO: 68243 - DNA, 22 bp, Artificial Sequence
  chemically synthesized
cttcagtctggttgctgtgtcc

SEQ ID NO: 68244 - DNA, 22 bp, Artificial Sequence
  chemically synthesized
cagtctggttgctgtgtcccca

SEQ ID NO: 68245 - DNA, 22 bp, Artificial Sequence
  chemically synthesized
agtctggttgctgtgtccccag

SEQ ID NO: 68246 - DNA, 22 bp, Artificial Sequence
  chemically synthesized
gttgctgtgtccccagggtggg

SEQ ID NO: 68247 - DNA, 22 bp, Artificial Sequence
  chemically synthesized
ctgtgtccccagggtgggtaga

SEQ ID NO: 68248 - DNA, 22 bp, Artificial Sequence
  chemically synthesized
tgtccccagggtgggtagatcc

SEQ ID NO: 68249 - DNA, 22 bp, Artificial Sequence
  chemically synthesized
tgttcatcccacatgggacaag

SEQ ID NO: 68250 - DNA, 22 bp, Artificial Sequence
  chemically synthesized
ttcatcccacatgggacaagta

SEQ ID NO: 68251 - DNA, 22 bp, Artificial Sequence
  chemically synthesized
atcccacatgggacaagtagag

SEQ ID NO: 68252 - DNA, 22 bp, Artificial Sequence
  chemically synthesized
tctaaagggttgaagcattgag

SEQ ID NO: 68253 - DNA, 22 bp, Artificial Sequence
  chemically synthesized
ctaaagggttgaagcattgagc

SEQ ID NO: 68254 - DNA, 22 bp, Artificial Sequence
  chemically synthesized
taaagggttgaagcattgagct

SEQ ID NO: 68255 - DNA, 22 bp, Artificial Sequence
  chemically synthesized
aagggttgaagcattgagctgt

SEQ ID NO: 68256 - DNA, 22 bp, Artificial Sequence
  chemically synthesized
aagcattgagctgtgagcttct

SEQ ID NO: 68257 - DNA, 22 bp, Artificial Sequence
  chemically synthesized
agctgtgagcttctcggttgct

SEQ ID NO: 68258 - DNA, 22 bp, Artificial Sequence
  chemically synthesized
tgagcttctcggttgctgcagc

SEQ ID NO: 68259 - DNA, 22 bp, Artificial Sequence
  chemically synthesized
ctcggttgctgcagcacaatcc

SEQ ID NO: 68260 - DNA, 22 bp, Artificial Sequence
  chemically synthesized
tcggttgctgcagcacaatcct

SEQ ID NO: 68261 - DNA, 22 bp, Artificial Sequence
  chemically synthesized
ggttgctgcagcacaatccttg

SEQ ID NO: 68262 - DNA, 22 bp, Artificial Sequence
  chemically synthesized
ctgcagcacaatccttgcccat

SEQ ID NO: 68263 - DNA, 22 bp, Artificial Sequence
  chemically synthesized
cagcacaatccttgcccatcct

SEQ ID NO: 68264 - DNA, 22 bp, Artificial Sequence
  chemically synthesized
gcccatcctgactgaaacaacc

SEQ ID NO: 68265 - DNA, 22 bp, Artificial Sequence
  chemically synthesized
cccatcctgactgaaacaacca

SEQ ID NO: 68266 - DNA, 22 bp, Artificial Sequence
  chemically synthesized
actgaaacaaccagaattcatg

SEQ ID NO: 68267 - DNA, 22 bp, Artificial Sequence
  chemically synthesized
aaacaaccagaattcatgaaat

SEQ ID NO: 68268 - DNA, 22 bp, Artificial Sequence
  chemically synthesized
atgaaatgcatcaaagaagtct

SEQ ID NO: 68269 - DNA, 22 bp, Artificial Sequence
  chemically synthesized
cacctactacgcaagcctggaa

SEQ ID NO: 68270 - DNA, 22 bp, Artificial Sequence
  chemically synthesized
acctactacgcaagcctggaag

SEQ ID NO: 68271 - DNA, 22 bp, Artificial Sequence
  chemically synthesized
ctacgcaagcctggaagggtga

SEQ ID NO: 68272 - DNA, 22 bp, Artificial Sequence
  chemically synthesized
cgcaagcctggaagggtgacta

SEQ ID NO: 68273 - DNA, 22 bp, Artificial Sequence
  chemically synthesized
gaagggtgactaagatctgaaa

SEQ ID NO: 68274 - DNA, 22 bp, Artificial Sequence
  chemically synthesized
agatctgaaaaacaccgggaag

SEQ ID NO: 68275 - DNA, 22 bp, Artificial Sequence
  chemically synthesized
aaaaacaccgggaaggctaaag

SEQ ID NO: 68276 - DNA, 22 bp, Artificial Sequence
  chemically synthesized
aaggaactcccacaaggaaacc

SEQ ID NO: 68277 - DNA, 22 bp, Artificial Sequence
  chemically synthesized
ccacaaggaaaccccattagaa

SEQ ID NO: 68278 - DNA, 22 bp, Artificial Sequence
  chemically synthesized
gaaagttctagttacaagatgc

SEQ ID NO: 68279 - DNA, 22 bp, Artificial Sequence
  chemically synthesized
tagttacaagatgctcagcaca

SEQ ID NO: 68280 - DNA, 22 bp, Artificial Sequence
  chemically synthesized
gttacaagatgctcagcacagg

SEQ ID NO: 68281 - DNA, 22 bp, Artificial Sequence
  chemically synthesized
caagatgctcagcacaggccat

SEQ ID NO: 68282 - DNA, 22 bp, Artificial Sequence
  chemically synthesized
agcacaggccatgcagaaatac

SEQ ID NO: 68283 - DNA, 22 bp, Artificial Sequence
  chemically synthesized
agtcacgcaggagagactcata

SEQ ID NO: 68284 - DNA, 22 bp, Artificial Sequence
  chemically synthesized
ataggggctcaagccagcaagg

SEQ ID NO: 68285 - DNA, 22 bp, Artificial Sequence
  chemically synthesized
aagccagcaaggggacggcctc

SEQ ID NO: 68286 - DNA, 22 bp, Artificial Sequence
  chemically synthesized
caccccacgcactgttggccaa

SEQ ID NO: 68287 - DNA, 22 bp, Artificial Sequence
  chemically synthesized
ttggccaacagcttccaggggc

SEQ ID NO: 68288 - DNA, 22 bp, Artificial Sequence
  chemically synthesized
gccaacagcttccaggggcatt

SEQ ID NO: 68289 - DNA, 22 bp, Artificial Sequence
  chemically synthesized
ccaggggcatttgctctcagaa

SEQ ID NO: 68290 - DNA, 22 bp, Artificial Sequence
  chemically synthesized
caggggcatttgctctcagaag

SEQ ID NO: 68291 - DNA, 22 bp, Artificial Sequence
  chemically synthesized
gctctcagaagtcaaagctgat

SEQ ID NO: 68292 - DNA, 22 bp, Artificial Sequence
  chemically synthesized
ctctcagaagtcaaagctgatt

SEQ ID NO: 68293 - DNA, 22 bp, Artificial Sequence
  chemically synthesized
tcagaagtcaaagctgattttc

SEQ ID NO: 68294 - DNA, 22 bp, Artificial Sequence
  chemically synthesized
agaagtcaaagctgattttcca

SEQ ID NO: 68295 - DNA, 22 bp, Artificial Sequence
  chemically synthesized
attttccacaattgaagtgctc

SEQ ID NO: 68296 - DNA, 22 bp, Artificial Sequence
  chemically synthesized
tccacaattgaagtgctcactg

SEQ ID NO: 68297 - DNA, 22 bp, Artificial Sequence
  chemically synthesized
ccacaattgaagtgctcactgt

SEQ ID NO: 68298 - DNA, 23 bp, Artificial Sequence
  chemically synthesized
  misc_feature (1)..(21): n is a, c, g, or t
nnnnnnnnnnnnnnnnnnnnnrg

SEQ ID NO: 68299 - protein, 9 aa, Artificial Sequence
  chemically synthesized
LAGLIDADG
